United States Patent 7,745,391 (HUMAN THROMBOSPONDIN POLYPEPTIDE) - sequence listing, part 160

SEQ ID NO: 415614 - DNA, 2659 bp, Homo sapiens
taaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgagatgcaacaactgttccatgaaaattatgaacacaatcggaagggttacatccaagaccttcacaatagcaaaatccatgcagccataacacttcatcccaacaaaaggcctgcataccaatacaggctgcataattacatgctcagccgcaaaatttctgaacttcgctaccgcaccatccagctccacagggaaagtgccctgatgagcaagctcagtaacacagaagtgagcaaagaggaccagcagctgggagtgataccttctttcaaccacttccagcctcgggagagaaatgaagtgatagaatgggagttcctgacagggaagcttctatactcagcagctgagaaccagccccctcgacagagcctcagtagcattttaagaacagcactggatgataccgtcctacaggtgatggagatgatcaatgagaatgccaagagcagaggacggctcattgacttcaaggaaattcagtatggctaccgcagagttaaccccatgcacggggtggagtacattttggatttactccttttatacaaaagacacaagggaaggaaactgactgtgccagtgagacgtcatgcctatcttcagcagttgttcagcaagcctttcttcagagagaccgaagagctagatgtcaacagtcttgtggagagtattaacagtgaaactcagtcattctcctttatatctaattctttaaagatattatcttcttttcaaggtgccaaagaaatgggagggcacaatgaaaagaaagtacacattctcgttcctctcatcggaaggtatgacattttcttgagattcatggagaactttgaaaacatgtgtcttatcccaaagcagaatgtaaagttggtcattatccttttcagtagggattctggccaagactccagcaagcatattgagctgataaaagggtaccagaacaagtaccccaaagcagaaatgaccctgatcccaatgaagggagagttttccagaggtcttggtcttgaaatggcttctgcccagtttgacaatgacactttgctgctattttgtgatgttgacttgatcttcagagaagattttctccaacgatgtagagacaatacaattcagggacaacaggtgtactatcccatcatctttagccagtatgacccaaaggtaacaaacgggggaaatcctcccactgatggttacttcatattctcaaaaaagactggattttggagagactatggatatggcatcacctgtatttacaaaagtgatcttctaggtgcaggtggatttgatacctcaatacaaggctggggactagaagatgtagatctctacaataaagtcattctatctggcttaaggccattcagaagccaagaagtaggagtggtgcatattttccatccagttcattgtgatcctaacttggaccctaagcagtataagatgtgcttaggatccaaggcaagtactttcgcctcaaccatgcaactggctgaactctggcttgaaaaacatttaggtgtcaggtacaatcgaactctctcctgacagtccaggcaacacattttgccttttttaaggggagtttacctcattgttggttgttgttatttttattgtattattgttattttattattattattgttataattttattttgttgtcctggtcttaaactactcttggttgtcttcctaagggtgtttgttgacctcaagcaagaagagtctgcagttcactgatgtttcagatttctactgaagtcaatatgttattacttttatataactttatttgagattgagttaaatcatagcaatcaaatgacttttgaaacgcattcatcacaagagacagcttagaagaatgttctcttggggcttaaagatgcaatatcgacttttatttggtttctcaaattcaatgtgatacaaatatttactggtgaaaggtaccacaaaagtgctttatgcttcctatggggaagggactctgtaacataaacttgagttttgtaatttatacaaggacttaaatatataaacaataattttcttcatctttagaatttttaaagtaaatgaatacctatgattgtatgtttattttttaaaaaaagttttaaaaattgaggagttttgttccacaagcaaccggtactggctaccctggtcttatgacaattatgagctcctcacaactgtctgctataaatgcgaatgaactttattttctcaaggaaatatgatttaattaaatattcatgtacattttagaagctttatgaaacaatgtccttcatttgctggcaagaagataaaatatgacagaacctgtttatttaaaataaaacacaggtatagcagtattctttttcaaaaacactg

SEQ ID NO: 415615 - DNA, 301 bp, Homo sapiens
taaacagcagtaagcctctctacctgggacagactggcctggggaatattgaagagcttggaaagctgggactggagcctggggaaaacttctgtatgggaggacctggcatgatctttagccgagaagttctcaggaggatggtgccacatattggtgaatgccttagagaaatgtacacgactcatgaggatgtggaagtaggaagatgcgttcgccgttttggtgggactcagtgtgtctggtcttacgaggtaagcatggagctgtgatgaaaatgttcacatagtacatatacatg

SEQ ID NO: 415616 - DNA, 2438 bp, Homo sapiens
gcgccagcaggaagtgggagaagaggcgacccaaggcgggctggcgggctggcggcagtcgctacttgcctagtagcctcagccgctgtgggctcctggggagatggaggggccggggctgggctcgcagtgcaggaatcacagccatggcccccaccctccaggatttggtcgatatggcatctgtgcacatgaaaacaaagaacttgccaatgcaagagaagctcttcctcttatagaggactctagtaactgtgacattgtcaaagctactcaatacggaatttttgaacgatgtaaagagttggtagaagcaggatatgatgtcaggcaaccagataaagaaaatgtgtcgcttcttcattgggctgctattaacaacagactggatcttgtaaggttttatatttcaaaaggtgctgttgtagatcagttgggtggagatttaaattcaactcctcttcactgggccatccgacaaggacatttacctatggtcatattattactccagcatggtgcagaccccactcttattgatggagagggattcagcagcatccacctggcagtattgtttcaacacatgcctattatagcatatctcatctcaaagggacagagtgtgaatatgacagatgtaaatgggcagacacctctcatgttatcagctcacaaagtaattgggccagaaccaactggatttcttttaaagtttaatccttctctcaatgtggttgataaaatacaccaaaacactccacttcactgggcagttgcagcaggaaatgttaatgcagttgataagcttttggaagctggttctagcctggatatccagaatgttaagggagaaacacctcttgatatggctctacaaaacaaaaatcagctcattattcatatgctaaaaacagaagccaaaatgagagccaaccaaaagttcagactttggaggtggctgcagaaatgcgagctcttcctgctgctgatgctttctgtgattaccatgtgggctattggatacatattggacttcaattcagattcttggcttttaaaaggatgtcttctagtaacactgttttttctgacatctttgtttccaaggttcttggttgggtataagaaccttgtatacttaccaacagcctttctgctaagttctgttttttggatatttatgacttggttcatcttattttttcctgatttagcaggagcccctttctatttcagtttcattttcagcatagtagcctttctatactttttctataagacttgggcaactgatccaggcttcactaaggcttctgaagaagaaaagaaagtgaatatcatcacccttgcagaaactggctctctggacttcagaacattttgtacatcatgtcttataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgtaaaaaaaaaaag

SEQ ID NO: 415617 - DNA, 1756 bp, Homo sapiens
caaatgtgaagttgtcagatgacatggcatgttttccgttgctcatgaatgtttagaagttggagaatgttgtctttgttacctaaagccagtgttcctgaaagacccagcccttggtgcttgtaactttcagttttgatgtatactggtgggtttttcttttttaatgtgtgtgtatatttgcatatttatttttctctagcagatcataactgggagatgattgccattcacagagatgaggtgataggtgggagtggtggggtggtataatttttatgcatcctaatttattagctgttggttgaaaatgcaaccttgaagagtcacatcatttcaagcacagaatgatttggtggcaagtattccaaattgcttttctaactacttcagtttggagcgagaactgtgagaatggtgtataaccatgcataatacattttccaataaaatgtggtaataggtcaaacttcatgtctttcagaatatcatcacccttgcagaaactggctctctggacttcagaacattttgtacatcatgtcttgtgagttttttcatataatttttttccgtagtgaaagcaaagtcttggtaacgttgctgatgtaagcatttgtcagatcttcatggtatatttatacacctttgtttttacccatttctaattttacattcctgtctgaacagctttctgtcttgaacatatggcagaatgatgtttataatctcttgaagttgtctctggttacatctctccgtgaattatccattgtgtgttttatttgcttttctctgtcatgaagcatatattagaactaacgtcaaatcagaggctcataatgaccttagaaaccacttagtgaaacctctcattttgcaattgaggaatcaagggaggaagtaaattctcccaaattattggtggtgataaaaatggaacttgggtttccttcccttggttgagtgcttattttgctctgtggtactgcctcatttctgcttagccagtatgaacaggctctggaattcagatcccacttagtgatgtcctaatcaaagtagacatatggaagtaaatactaataaggcattccacagcctctgtgtgaattgatggtctgtttaggatttgtgccaatgcctctgtgacctaaagttaaaattttgcttgtgatttgttaccactttgagacactggtttttgcttaggcctctcttaattgcccacttagataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctgtaagtgtaaatttttcttacaacaagcacatacatctacacccatttctacttttccttgtaaacccttgtatatcacattctggctgggtgactataaaccatactcctaataaaaacaaagcaaatgcctctaagactccctcagcattgggaagctgcaagaaatacaagatgaggttagttctcagtactttaggaaaaaaatgtgataaatttgaaaagtagtcaaaaatagaaattcatttaaggcaagtgcagatttgctccccagtgaagaaggaaagtcagctgctgaagtacaaagctggaggtgataactgaataaaacaggaaaaaaaaa

SEQ ID NO: 415618 - DNA, 641 bp, Homo sapiens
caatgaataaatattagttcagttaacatggacaattgactgtgacatatcagaaatgtgtggtttgatttaatggtacttaaaagcaaagcaacagctttatttctgttttactttggtgaagacttttgacaggaaagtggttaaggaggtcttatgttgaaaatcagaagaaacgaaaatattaagtatgttttttttcttttttcttgaggttttggcaaccatcactattacatattcttcttgtttttcctttccatggtatgtggctggattatatatggatctttcatctgtaagtgtaaatttttcttacaacaagcacatacatctacacccatttctacttttccttgtaaacccttgtatatcacattctggctgggtgactataaaccatactcctaataaaaacaaagcaaatgcctctaagactccctcagcattgggaagctgcaagaaatacaagatgaggttagttctcagtactttaggaaaaaaatgtgataaatttgaaaagtagtcaaaaatagaaattcatttaaggcaagtgcagatttgctccccagtgaagaaggaaagtcagctgctgaagtacaaagctggaggtgataactgaataaaacaggaaaaaaaaa

SEQ ID NO: 415619 - DNA, 2274 bp, Homo sapiens
caaatgtgaagttgtcagatgacatggcatgttttccgttgctcatgaatgtttagaagttggagaatgttgtctttgttacctaaagccagtgttcctgaaagacccagcccttggtgcttgtaactttcagttttgatgtatactggtgggtttttcttttttaatgtgtgtgtatatttgcatatttatttttctctagcagatcataactgggagatgattgccattcacagagatgaggtgataggtgggagtggtggggtggtataatttttatgcatcctaatttattagctgttggttgaaaatgcaaccttgaagagtcacatcatttcaagcacagaatgatttggtggcaagtattccaaattgcttttctaactacttcagtttggagcgagaactgtgagaatggtgtataaccatgcataatacattttccaataaaatgtggtaataggtcaaacttcatgtctttcagaatatcatcacccttgcagaaactggctctctggacttcagaacattttgtacatcatgtcttgtgagttttttcatataatttttttccgtagtgaaagcaaagtcttggtaacgttgctgatgtaagcatttgtcagatcttcatggtatatttatacacctttgtttttacccatttctaattttacattcctgtctgaacagctttctgtcttgaacatatggcagaatgatgtttataatctcttgaagttgtctctggttacatctctccgtgaattatccattgtgtgttttatttgcttttctctgtcatgaagcatatattagaactaacgtcaaatcagaggctcataatgaccttagaaaccacttagtgaaacctctcattttgcaattgaggaatcaagggaggaagtaaattctcccaaattattggtggtgataaaaatggaacttgggtttccttcccttggttgagtgcttattttgctctgtggtactgcctcatttctgcttagccagtatgaacaggctctggaattcagatcccacttagtgatgtcctaatcaaagtagacatatggaagtaaatactaataaggcattccacagcctctgtgtgaattgatggtctgtttaggatttgtgccaatgcctctgtgacctaaagttaaaattttgcttgtgatttgttaccactttgagacactggtttttgcttaggcctctcttaattgcccacttagataaggaagccattaaggtcactccactgccatgtatgcaactgctgtgtggctcgatatgatcaacactgcctgtggactggacggtgcataggttttggcaaccatcactattacatattcttcttgtttttcctttccatggtatgtggctggattatatatggatctttcatctatttgtccagtcattgtgccacaacattcaaagaagatggattatggacttacctcaatcagattgtggcctgttccccttgggttttatatatcttgatgctagcaactttccatttctcatggtcaacatttttattattaaatcaactctttcagattgcctttctgggcctgacctcccatgagagaatcagcctgcagaagcagagcaagcatatgaaacagacgttgtccctcaggaagacaccatacaatcttggattcatgcagaacctggcagatttctttcagtgtggctgctttggcttggtgaagccctgtgtggtagattggacatcacagtacaccatggtctttcacccagccagggagaaggttcttcgctcagtatgaagaaaagcaacccaaaactctcaatctgatttgtttttgtttatgtcgatgccctgtagtttgaaagtgaagtaaagatttagaattcacctaagtccaaaggaaaacacgtggtttttaaagccattaggtaaaaaaagttctcaataaaggcattacaattttttaggtttagaaagatggacttttctgataaatcttggcagacatctaaaaaaaaaaccatatttttcacaagaaaatgcaagttactttttttggaaataatactcactgattatggataaaatggaatattttcagatactatattggctgtttcaaaatagtactattctttaaacttgtaatttttgctaagttatttgtctttgttgtatctataaatatgtaaaaaatatttaaatagatgtacctgttttgctttcacacttaataaaaaatttttttttgtaaaaaaaaaaag

SEQ ID NO: 415620 - DNA, 674 bp, Homo sapiens
agctgcctcctctgcagaaggagcctactatggggaatgttaggataacatcagcacccacaccaggaggatacctctggggtgacggggcgaggcagaggttgaggggcattcctgttctttgctgaaagggctgtgggaggggcaaacaggactcctagccctgtggcctcctccaggaatctcctgtaggttatcttcctttaaggtttttctggtcattgtagtaaaacaaactgttgacccttgcgcttagttatgtagggtctgaaacatgcctagtggtagggagacaacagcatctagcatgttgtttcttttccggccttgcttagagttctttagtagggaaaaaaaagttatataattattatgcccccacgaaaaacaaaacgtcaccagtgcaaaggccctatcttgagctgggcctgaaggttgaggtgctttgagaggaggaggatcaggggagtaagggacacaaggtgactgatgttcctgaaggacagggtgcaggtgagtgagaagaggatgagctgaggtcagtttgcagcagtgacgggaatgggaatggcagtgatagaatcaaaggattttatatttagagaagagtttattatgatccacctgtctcactttatggatgagaaaacagtctgcaagagtttaagtagctt

SEQ ID NO: 415621 - DNA, 1152 bp, Homo sapiens
cccaaatcgccctgactgttctctgccttgagtccccaaatccctgccgtggggcgcagcctgtcatgcatgggccaggaggacagccagcacacggggcagatgccgcaggtcatccagctacgttttctgtgcattcatctcaggaatacgggtttccctgcacacttaaatctacgtgtaacccaagtttatagacctgctgggaagtggaaggcagttggttgcctttctcaaaggctgctccatgagcaagatgcctttcatctagaccattccgctggaagcatctgtcagaccagagtagtgcatcagtctaaagtcagctctctcttctctggtttagggtggtagttgtgtgctttggttctgtttagctgagtgggtgaatgaaagtaattaagataccctaaatagggtctttagctaaacggtcacctccctgcctaattgtgacaccaataaatccaagaaaggggaggacagtggcagcaggtcacagtgggaggatcatggcttggagcaaagacaagggctgtgagttccagccctgccaccattagctgcagtgtttgcgcagttggtttcacctcccaggtcttcaggttcttcatagggtcagaactccaggtagatcattcctgggcttccttcagcttgaaaaatctctgcctcaaccatattctaatcacaacattactataaaatgataggcatgacttctatatttacaaaaagccataatgtatttcctcactctctgtaggaagacatttgaattgttacattctttactttgctctaaagcaaggttgtggaaggtttcaggtgccagcaggtttctcagggctagagtctgtaacaaagagatcctggaaaactggagagaggttggggaggagaggaatggacacagcgtggttctggtcccacagaggtcctattgtctgtaagaatttgatgttggctaaaagagacatcaggagtcactggggagggagaaattatgctgtaatggtcagggaaagtggttagactttttcaaaaacaaacaaaatgtaaaattttacatcttcactttaccctatatagccaacttaaactccaagatagatctaacagtaactctttgttaaaaaaaaaaaaaaaaaa

SEQ ID NO: 415622 - DNA, 373 bp, Homo sapiens
tactactaaattcgcggccgcgtcgagcatgacttctatatttacaaaaagccataatgtatttcctcactctctgtaggaagacatttgaattgttacattctttactttgctctaaagcaaggttgtggaaggtttcaggtgccagcaggtttctcagggctagagtctgtaacaaagagatcctggaaaactggagagaggttggggaggagaggaatggacacagcgtggttctggtcccacagaggtcctattgtctgtaagaatttgatgttggctaaaagagacatcaggagtcactggggagggagaaattatgctgtaatggtcagggaaagtctaaccactttccgtcgacgcggccgcgaat

SEQ ID NO: 415623 - DNA, 355 bp, Homo sapiens
ggacgccatgtgctgggggagcacttgcagcacttgcattgagtaataaactcctgtctgcattgcagctgctgggggtaggtggtggagggatattgcccacagtgaatgacctccccaggcaaggtggcaggaagccggagacaggcatcagctcagcatcctccaattagctgccatccctgaccccatcaaggctggaggaagtgctggcgcttaccagcactcaggcccacctgcctggagggctggcagactcagcagttggggtggcggcacctggaggtcttggcctaacagagcctcacttattccagagatctgtaaagggttagtgggtggggggctggcaggc

SEQ ID NO: 415624 - DNA, 353 bp, Homo sapiens
ctaatttaaaaaactatattaatctgcctttaacaagttattttcagttaaaagtaataatctttttggatgtagctggagggaaggaattaatacttcagagaagttagatcatgtttattttaaatagtgagtaataaaattttcattaatgtgtttaaaaataaccttcacatgtaccccataaatttgtacaaatataatacatcaaaaaaataaaaataacaactacccagacaaatttaattcaaaatttttttggccattcccttaggaaaccaactttctgtttagtgaaaaagaccactatagtatggagcctttatcactagaatgcagttgaaaatagaggc

SEQ ID NO: 415625 - DNA, 456 bp, Homo sapiens
cagtttaaagatactatgttttgcaagtctgagaaaggtgacgagtgaacttcattaccatgaattcttagctacacattatattgtctttatttgtaaccttctagatttatgctaatgcagaaatagctctttgatgaaaagtttttgaagagtagacctttttcccctttatatgcaccatgtaccagaggtttgcacatattgagcactgtaaattttacatttaaagtaatataaaaagatgtgaatttttatgacatttatttggaatgccattttgtgttttgactcaatcgttcattagctatagttaaattataaatttgtaacgattacaaagatttcttagtctgggtcatggtggctcacacctgtaatcccatctctttaggaggccaaggcgagaggatcacttgaggtcaggagttcaagaccagcctgggaaacatctat

SEQ ID NO: 415626 - DNA, 443 bp, Homo sapiens
gagcacttaactatgtgtaaggcactgtgtttataagaataaccttaaataatcctcacaaagtttacattatacagaggaagaaaatgagttcttcatttcttcattttcttcttaatttgttaagaacatacagttaggaaggggcagaactggcactgagtcccagatttccaactttaaaactccatgcccttaatagccattttcctactctacctcagggttcctgctcaaggaatgtatagactagtaggcagattatgtgaaagcaagtaaatatttcctgtaatggaagtgtgtacctagtggagcgggcacatggggaaagaatcacctgagttggcctgggtaagtcactgaaggcttcatggaggtgattgtgcctgagctgaaagtagaaaaatgtgtaggtatttatggtaaatcttgggcaagcctgg

SEQ ID NO: 415627 - DNA, 1272 bp, Homo sapiens
attttaagccacttgtttggtgttatggattttaagaatcagttggtgttagaatttttaataacacagagaaagccattgaatatggaactcaaattatctaaggtttacccagaagtcaaaatcacctggccctctgtaaatttctctttgtgttcctaggcccacaaagtctttggtctgaagactcagagcttaaattgcattggtcctgttaatctttgtcaaaaaggaagtttgggcggcagtttcagggtagtgttgagaagataactcctggtcccattttattctttcctcatttgttcagtgctcatggccatctacaaccttccttgattctattctgcctaagcctcttatttccacatctataagtatagtgctacataataattacaacctttaagaaaatggagagttttcattaaagggcccctgcaaatctatgatgctagatgacagattctaccagaaggccagagtattaatagcacccgtgataactgtaataagaatatgtctcgttttcttttaaagacatagatattccattttaatcctgtataactcaaagaaaatttgggtgttaacactttgaaatacctttacctcctttgggggaaatccaaactgaaaggaattaatatccacatcagttcctaaagcaaaatgcctgacacagactaacaaagctctttctcatcctgtggtaggaacttaggagtgataactcacattgagaacttgtgatctgaaagcactaaggaatttctgccattgcaggtaggaaaaaaaaagacaaaaatggtattctcaggtgagcttacctttcaaatttttctgagacttcctaaatgtgacaagaactctgctgtgtggcaaccttatgtatccacaacagaactaaggaccgaaaaaaaaaaaaaaaagatctctatcccaatagattttataaaatccatactctaaaactcctgagttttacatgtaccctaaaacttaaagtatagtaaaaaaaagaaaagaaagaaaaactctttaaccctttgtttaaatcctattaactcttaacgatacacagttcgaattatctaaatgaaataattttcaagcacataacagattagaaacagagaatgagaaaggtatagtagatattatgtaaataagcagaaataatggcaataattaaacacactatctctacctaaaagaacagagatagaaaactcatataaaaatctaaactacagttttatggggatagtt

SEQ ID NO: 415628 - DNA, 884 bp, Homo sapiens
ttctggcttgtagggtttctgccaagagattccttgttaatctgatgggcttccctttgtgggtaaagtgacctttctctctggctgcccttaacattttttccttcatttcaaccttggtgagtctgatgattatgtgtcttggggttgctcttctcaaggaatatgtttgtggcattctctgtatttcctgaatttgaatgttggcctgacttgctagattggggaagttcttctggataatatcctgaagagtgttttccaacttggttccattctccctgtcactttcaggtacaccaattaaatgtagatttggcactgttcatgacttcaggtaaagatggctcatatttgacagcttacagaataacatgagagtgttataaacacacattcccccctccccacctttatccttcctgaattgctttacaagccgtttaagaacaatttaatattcctgtgtgcagcagttcagttttcttgttttgctttctctcatttttctctttaaggctcaattgtctgtttattttcatttgtatttattattgttgttaagtgacaaatggtcattgaaacataataccttacagtaagtaacctcttttttgttcagtacaattctatagtttttgtgagataaggaactgattctgcttactatttctgtcacattggtagaaaatgtatagcccctatttgcaacaacacgtgaatcatattgagaggaggccagtctgaattatattttttatggaaaaatactttgaaataacttaggcacgaattttaagtacatttcttctgcagttgttttagtgaatgtaatgtatttaaattttaaataaaggacatttattaacctgcaaaagtgctga

SEQ ID NO: 415629 - DNA, 387 bp, Homo sapiens
ataatggctcatgtgaatgtttccatgagaatcttatagtaactgtatcacagtttattcattaattctctactgatgaacgtttacttttttgtgagatcttgaccatcaggaacagtattgcattgcacgtccctgtattttaagttcacatatactggtacttttatttcagtgggctggatttccagggatcttaatggataaggaatagatttgaccaggaatgtgttcaattactgttatatgaagaatcttgaagcaaaaaacattaaatatgaggaagttattttctaaagacagggtttcattcctgttgtcccagctggagtgagccaagatggcaccactgcactccagcctgggtgacaaagtgagagaccttcc

SEQ ID NO: 415630 - DNA, 500 bp, Homo sapiens
gtgggctcttcaaagtagaggatgctctatacacaaaggagtttgttctttgaattatcttttatttattgacagctggggtgatgcagggctgtttcctgtgttaagagagtgtcagttacttagctaatcatatttatcacccaggattctttatttgttgatagcactggagtatattggagtttttgtgtgctacgtgtatatttccctagctgcagtgaatgtggtttttatatttatgtgaaactgctaatgtgttgctcgctagatcatgagcaatgggcttctgacagctctgttcattagtcagcttgggggaaaaaataaaagaaaacacattgatatagaaacagagtgtgagccagcaattatcatcagagagcacaattgaagccacattttatttaaatatttatcttgtgaattgattcatacaaaacaagaagctgttttttatttatgaatggcttcaccgccgaaatttgaagagcaggaac

SEQ ID NO: 415631 - DNA, 1135 bp, Homo sapiens
cacaacatgtcacaatttagtgaggagctacatgtatttccaagaattccagcatagattataatttaaataatcgaattggtatttaggtacatgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattcactgggtaattgtgggtcatttatttcctgaaagtcacgtgaaatccttagctggttgaatgttgcacagtatttgagaattacggtttgaagtgatttctgtgggagggaatcattgcaatgtatattctaaataaagtcatctaactatta

SEQ ID NO: 415632 - DNA, 3579 bp, Homo sapiens
cacaacatgtcacaatttagtgaggagctacatgtatttccaagaattccagcatagattataatttaaataatcgaattggtatttaggtacatgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattcactgggtaattgtgggtcatttatttcctgaaagtcacgtgaaatccttagctggttgaatgttgcacagtatttgagaattacggtttgaagtgatttctgtgggagggaatcattgcaatgtatattctaaataaagtcatctaactattaaaaaaaaaacacccttcctaacccttcttttcttaaaattccacattcatccacaatctcatccctttgtagaaattcttgcctgaattctcaccaagttttgaattcctaaggtagccccgatctaggatgtgaaggctgcccagaaaaagtttatggctggaggagtatcatacagtgtctacatatgatagtacttacagattaggtctttggatgctttaacacaaaagatttttgttatccttattagtcaaataacgctattcttttgtggttctagaccctggcttctatctccctgtgatttgttttaatgctgaaatgacttggctatccaaagcttctagtctagaggtctgttggttgaaggcagacatttccaagtttgttgaaataatacgaagctgactagcttacgtgaatgatgttgccctcatttgttttgggtgaggactcattactgcagtatattgatctcttcaccaaatgctttttctttttctgaataaatgctgtattagaggttctatttatatatgatttttaaaactttggtttccttctatccaccaaatactgtgaattgtttttccatttatttttcttagctaatgtaactttattcttcacttttttttagccctagacttcctagattttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttattgtattttttaacctttttgtttctattcctacctcccatgagtaacattgatttctgctgaagttagaatttgtgttaagaattgactttaaatttctgaaatagttgaatattagaagtggcttcagttgccatgaaatgattgcttttctttttctttttttttccttaaataaaaataatgcagccttatatatgtctcttcccctcaagaatgtgaatttaggctgggcatagtgactcacgcctgtaatcccagacctttgggaggctgacacgggaagattgcttgagcccaggaatttcagaccagcctgggcaacacaggaagactccatctctacttaaaatatttttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaagaatgtgaatttagctccaattccaaatgactaactcttaggccagtcatagccaatgaaatcatctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagcttaaaaacacaaaaatgaaagggtagtcctagtttatcttcttaattagaatcattatttggaaataagatttgcaatgtgctgtctatccccaaacactgctgagcttgctggaaaacagaatttaacatgaatgttgtctgaaagctgtaggatcaatggcaaaaaaggggaaatgtttggtagggaattggaccagttctaaggtatcacttttaattataaaataatgtcttcctttttatctgcttttcagacagcctcagtgaactattaaacatttgtgtgcaaagtcctattttgcttatctaaggcattttgacttggaagtattaaacttcaggaacgagctagagaagacaatgagggtatgttagagaaggaaaaataggagctttttgcttatggattttagaggtccacaaatcgaaaggaaaaataaatttcttcatttctaaccctaaaataattttgttaatgagatgctgggaagaagactaccaaaaggcctcaaagctcatgcttctagaatattcagtaattctgaatagtctttgggaagtagcatttcttgggaagtagcatttcccttctcccaaataactgtttgagatcttaaaacagaaaatccagtgttaatgggctctagatcttaaactaggtgagcagcttcttacatacaaccagttccttg

SEQ ID NO: 415633 - DNA, 416 bp, Homo sapiens
tcccattctcatctttcctatcaacccacaaacatgctgaaacatgttgctcctatcttagtgcagtggctcacactagtaatcccagtactttgggaggcagaggtgggaggatagcttgaggccaggagtccaaggctgtagtgattcatgattgcgccactggcaccccagcagcctgggcaacagagcaagacccccctcttttaaaaccacacacacataattaaaattcctcttaactcacttccccctccatttattgcccaatttctctaccctccatttataataaaatttcgtggtggctcactcctttaggcccagcgactccaaaggagggtcgcttgaggccaagagatcaacgctgccatgggctaggatcatgccactgtactccagcctgggccacagag

SEQ ID NO: 415634 - DNA, 297 bp, Homo sapiens
ctcgtgcgcttttggtgacagctaatgtttccaacaaaggccaaatccatcccttcttacctactctaggacattgctctagccattgtcttctttccgacatcaactttcccattctcatctttcctatcaacccacaaacatgctgaaacatgttcctcagtctcccaaagtgctgggattacaggcgtgagccaccgcgcccggcctctcacttcctttcttagccagcttaaattccatggtcaatcattaagagaactcctttgtacttctccccctcacttcttcatatcc

SEQ ID NO: 415635 - DNA, 296 bp, Homo sapiens
aagtcactaaagtaagcaaagaagagatgactgtggtttggaatccacctgaatatgatggtggaaagtctataactggatactttttggagaaaaaggaaaagcattcaacacgatgggtccctgtcaacaagagtgcaatccctgagagacgtatgaaagtacagaatctcctcccagaccatgaatatcagttccgtgtcaaggcagaaaatgaaattggaattggagaaccaagcttgccttcaagaccggtggtggcaaaagaccccataggtaggatgtccttgtttttt

SEQ ID NO: 415636 - DNA, 6163 bp, Homo sapiens
ggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatattgtgtgtgtatgtgtgtgtgtgtgtgtgtgtgtgtataagcatacatgggaattttctgaatgtaagcagtttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaagtgtttcttctaactctccttcttctgaattgtgcagagactctgttaacttccctttttggcacttagataacttcctattcaaccccctcctttatcttggatttctaaagtttttccccaatattgggaatggtgaggggtggggatgagagactctctgaacaattcttgcagaaccagtgacaatcttatgaatataatgaataagtaagcttatgagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttcaaaaaaaattt

SEQ ID NO: 415637 - DNA, 5818 bp, Homo sapiens
  misc_feature (5706)..(5706): n is a, c, g, or t
ggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatattgtgtgtgtatgtgtgtgtgtgtgtgtgtgtgtgtataagcatacatgggaattttctgaatgtaagcagtttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaagtgtttcttctaactctccttcttctgaattgtgcagagactctgttaacttccctttttggcacttagataacttcctattcaaccccctcctttatcttggatttctaaagtttttccccaatattgggaatggtgaggggtggggatgagagactctctgaacaattcttgcagaaccagtgacaatcttatgaatataatgaataagtaagcttatgagggtgatagaatacgattgttcaacaagaggggcgaacctttcagctnttctcgagacatggacccaggagggtttcggcaacttttcgggcttaaaaagtcccccgtctgacttggtccgggggtgccccccggggttttggcgggaaacacccccttg

SEQ ID NO: 415638 - DNA, 6124 bp, Homo sapiens
ggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatattgtgtgtgtatgtgtgtgtgtgtgtgtgtgtgtgtataagcatacatgggaattttctgaatgtaagcagtttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaagtgtttcttctaactctccttcttctgaattgtgcagagactctgttaacttccctttttggcacttagataacttcctattcaaccccctcctttatcttggatttctaaagtttttccccaatattgggaatggtgaggggtggggatgagagactctctgaacaattcttgcagaaccagtgacaatcttatgaatataatgaataagtaagcttatgagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttcaaaaaaaattt

SEQ ID NO: 415639 - DNA, 6015 bp, Homo sapiens
ggaggccggactggactaagggggcaggagcggcgcctggggcgctgcggcggggctctagaccgcgggaagccagtgctagcgctggcgcgtggtgggcccctgaggccgccggagtccggagagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatattgtgtgtgtatgtgtgtgtgtgtgtgtgtgtgtgtataagcatacatgggaattttctgaatgtaagcagtttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaagtgtttcttctaactctccttcttctgaattgtgcagagactctgttaacttccctttttggcacttagataacttcctattcaaccccctcctttatcttggatttctaaagtttttccccaatattgggaatggtgaggggtggggatgagagactctctgaacaattcttgcagaaccagtgacaatcttatgaatataatgaataagtaagcttatgagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttcaaaaaaaattt

SEQ ID NO: 415640 - DNA, 5617 bp, Homo sapiens
tgtcttgtttccatttatttctgcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatattgtgtgtgtatgtgtgtgtgtgtgtgtgtgtgtgtataagcatacatgggaattttctgaatgtaagcagtttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaagtgtttcttctaactctccttcttctgaattgtgcagagactctgttaacttccctttttggcacttagataacttcctattcaaccccctcctttatcttggatttctaaagtttttccccaatattgggaatggtgaggggtggggatgagagactctctgaacaattcttgcagaaccagtgacaatcttatgaatataatgaataagtaagcttatgagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttcaaaaaaaattt

SEQ ID NO: 415641 - DNA, 3888 bp, Homo sapiens
tccccccactaaccgtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatattgtgtgtgtatgtgtgtgtgtgtgtgtgtgtgtgtataagcatacatgggaattttctgaatgtaagcagtttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaagtgtttcttctaactctccttcttctgaattgtgcagagactctgttaacttccctttttggcacttagataacttcctattcaaccccctcctttatcttggatttctaaagtttttccccaatattgggaatggtgaggggtggggatgagagactctctgaacaattcttgcagaaccagtgacaatcttatgaatataatgaataagtaagcttatgagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttcaaaaaaaattt

SEQ ID NO: 415642 - DNA, 2113 bp, Homo sapiens
ttttttttttaggaataagttattattaacacttgctccccaaacaggagttagaaaactatattggtaacagatctagagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatattgtgtgtgtatgtgtgtgtgtgtgtgtgtgtgtgtataagcatacatgggaattttctgaatgtaagcagtttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaagtgtttcttctaactctccttcttctgaattgtgcagagactctgttaacttccctttttggcacttagataacttcctattcaaccccctcctttatcttggatttctaaagtttttccccaatattgggaatggtgaggggtggggatgagagactctctgaacaattcttgcagaaccagtgacaatcttatgaatataatgaataagtaagcttatgagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttcaaaaaaaattt

SEQ ID NO: 415643 - DNA, 622 bp, Homo sapiens
ggaggccggactggactaagggggcaggagcggcgcctggggcgctgcggcggggctctagaccgcgggaagccagtgctagcgctggcgcgtggtgggcccctgaggccgccggagtccggagagggaccgaaggctccggtggcacccgggctatttctcagaggacaattagtaacgtgtcgccatgaggagccggagtaactccggggtccggctggacggctacgctcgactggtgcaacagaccatcctgtgccatcaggtaactgcaggggtgtctctcgtaatcaccgagcgaggatgtagcttgtcatagcttggacggagaccttggatgaactccgtgcgtgcgtgcgtgtgtgggtgtgtgtgtgtgtgtgtgtgtgtgtgtgtgtgtgtgacggagaccttgcatgaactccgcgtgtgtgtttgtgtgtgtatctgtatctgtctgtagcaggttctcccgcccctgttaattatatattttttctgctggtttttcattgctagttcgctagttcattctaactagaaaggtaaaactttcttttaataatacccattataaatgcacttaataatacctttaattgtgcctttaataatacccaca

SEQ ID NO: 415644 - DNA, 2868 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacata

SEQ ID NO: 415645 - DNA, 2904 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacata

SEQ ID NO: 415646 - DNA, 1526 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatg

SEQ ID NO: 415647 - DNA, 1562 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatg

SEQ ID NO: 415648 - DNA, 1550 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggtcagtgcgggtctgtgtagggccatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatg

SEQ ID NO: 415649 - DNA, 608 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccaggtcagtgcgggtctgtgtagggccctgttaccaccggatgtggaagttgatctcttcgctggtaaaaaataattccacttcccccggaacccagatcatccccgcgatttcctgtttattgcattaaggcgccgggtttccggggctcctggccccgcttattccgcgggggtcggcggggtcggcctgggcgcccgcgccgccgctgcgctttgtccgctgggcacactgcttctgggaggggcgggcagacatggtggcggccgc

SEQ ID NO: 415650 - DNA, 2933 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacataaaaaaattgtagacttatgtttttatcacatcttattaacacattaaaaatgttatcctactgca

SEQ ID NO: 415651 - DNA, 2844 bp, Homo sapiens
atcatgcgtaacgactctcttaataaccagcgctaccggtcacagcatatttgtggaggaaggattattccctcctttgctggacctctagtatccatggcacttgcccattaaatgctagcagagcatcctcaccttcagtctccaaaatgcctctataaacatacaaagggccctgaagggggcagtgctgctaccaatgagaaccactgatttccaagaatccatctacattaatctaccatatggcggccgggcgcggtggctcacgcctgtaatcccagcactatgggaggccgaggcgggcagatcacgagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacata

SEQ ID NO: 415652 - DNA, 3017 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacaggtctggtatcttcagaaaattcatccaaggcaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaaagagggtgtcttgctatgttgcccaggctggtcttggactcctggcctcaagtgatcctcccacctcagcctcctgaagagttgagattactggcataagtcaccatatccaggagagagaagctcttcagaaacagctggatgaagcaaatcgagaagcacaaaaatatcgacagcagctcctaaagaaagaacaggaagcagaggcctacagacagaagttggaagctatgactcgtcttcagactaataaagaagctgtttaattgaaatgaacatgtagtttgattttacttttggtcaagaaagaatacaatcttgaactgtacacaacaaaggtacagccatgggaatacagaatgatagaagagactacagatggataattggacttaagccatgagctctgagttcttgtaacataaaactttactttagaagttgtgaaatgtatttaaaactgaattctgtaaatagtttttttttttttacagttccaaatgagttgataaagattgttgaagagatccaaaaccagaataagccactgtttttgtgaattctttttgattttagtacaaaccttaatttctcagaaacggaacagttttaagggtgatcgttgttggttaggccaaatgttgtgtaataattatggtggactgatgctggaattactcctgtaggtataaacctctgtatgaagagaagatttctcccaggaaatctttgtacagctttaagttgtgtcagattctctgaaaacattttttagaaagcaaaatttttatatttgttcaatttcagctatacccaagtagatttacatgtatatgaagcaaatatttttaaaaatttctgtttgtacatattctgcatgttttataatttcaaaatgcatcacttacataggtatttctcccacagaaatgatgaaagtgaccagaaaaaaacaaaaacaaaacccctttactctgtaggtcattgaaacgaagtaagctggcagctggttttattggaatgacagtgttctcggaaggagcagcctacaagataacttgaatttgccaattctgcaaaatctgtgcttttttgaaaatttaagagtggggacgtgaaactgtattctgtgccttccatcatgatttccacatgaaagcactttaaggcactgattttaagataatgtttttggaaaacccaatgcatatgggtttctgaaatattttatggacttatttctccccaggaaatgattcttacggaaaaaaattgcttttgtatgtagaacaggaactttttgtattacagtgatgcaatagacatgtctaatgtaacttctacttttccttttgaaagctcagtgtctgtgctatgacttgctctcatcacaatattgttgaattccacaatgtatggacattaaacactggcagactgttcactttttcttttttttttttggtaaaatattacttcaaacccctttttcttgctttatttttcagtgttttattgctttatgaactgtttaaccctgaaatccctctaggttatctatactgtataaaaaagcaattacccttaaaactgtactctggcctacttttctattttgcaattaaatatctttttcacata

SEQ ID NO: 415653 - DNA, 1929 bp, Homo sapiens
cccgcgggaacacagctagggagtgggtaggagcaggatctgccgacgagggcagaggcggaaaatcctcgggcgatgagctgaagagggccgggtccgggagggatgctgggagcttgactcactcgcacaccatgtgtccctccgcgcgcagcacgggggacttttcggtggggattttgggcgccgaccagacgcggcattttcggaaaatagcgccctgtgcagctgaagcgctttgtgtgtagcggggccgcgtcagcccggccgggtacgaggcgcctcgggtccccgcaccacctcctgctgccttcccgtcgccgctcccgaagcttttccagatgtccctggtagatttgggaaagaagcttttagaagcggcacgagcaggtcaagatgatgaagttcgtattttgatggcaaatggagctccctttactacagactggctgggaacttctccacttcatctagcagcacagtatggtcattattccaccacagaggtactgctgcgagctggtgtgagcagagatgccagaaccaaagtggaccgaacaccattacatatggcagcttctgagggccatgccagcatagtagaggttttacttaagcatggtgctgatgtcaatgcaaaggacatgttaaagatgacagctctccattgggccacagaacacaatcatcaagaggtggtggaacttttaatcaaatatggtgctgatgtacacacgcaaagtaaattttgtaaaactgcatttgatatttcaatagacaatggaaatgaagatttagcagagatattacagattgctatgcagaaccaaatcaacacaaacccagagagtcctgacactgtgacaatacatgctgcaacaccacagtttatcattggacctggaggggtggtgaacctaacagatgaaacgggtgtatctgctgttcagtttggaaactcttctacatcagtattagctacattagctgccttagctgaagcatctgctccattgtccaattcttcagaaactccagtagtggccacagaagaagtagttactgcagaatctgtggatggtgccattcagcaagtagttagttcagggggtcagcaagtcatcacaatagttacagatggaattcagcttggaaatttgcactctattccaaccagtggaattggtcagcccatcattgtgaccatgccagatggacaacaagtattaacagtaccagcaacagacattgctgaagaaactgttataagtgaagaaccaccagctaagagacaatgtatcgaaataattgaaaaccgggtggaatctgcagaaatagaagtaaggagtcttttacccggtgtgctttgccgcagtcatccaaaataaattcaattttttttgtcttttatatttattactgacagtattgttttgatacagaatgaaagtgcgtagtattttcattttgtttatttttgccttatacatatagcaagccctcaataaataaatattgaatgaatgaatgagtgagtgaagaatttgtttataacagtctgtcatcttgataacactggaatgtctttggttcttccacttcatcctttatgttttaaacttacacacaccattcttacacgtcactaaaggaaaataccagtatatattggctaaaattttttttttgttgttcaaaactgaaactcaaatgcctaattgggctaggggtcctcttaaaggaggttgatgtttgtcaaatgggttattttttaaaagcagtagataattgcttatttcaaggcaagtaaatgaatttagactagctgttcataggattcatcattttttcccctctcccaaagtaatttgtaagcgtaaaccagtttgtaggtgtaacaaaaccatagttgcttcacaggtttttttc

SEQ ID NO: 415654 - DNA, 249 bp, Homo sapiens
gtgaattgattgaaaaggcaagatgtctaggaaatttcaataggtggctgcttttagctactacggtttttttttttaatttgaaggatgcatgcttatatgtattaataatgtatttttgcaaaaattaaaaaaaaaaccctcttcttttaattaggagagagaagctcttcagaaacagctggatgaagcaaatcgagaagcacaaaaatatcgacagcagctcctaaagaaagaacaggaagcaga

SEQ ID NO: 415655 - DNA, 3776 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 415656 - DNA, 1298 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgccctgcaggtgtcgtgcttccgtgaggagagggacgtgttggtgaatggggaccggcggtggatcacgcagctgcacttcgccttccaggatgagaactacctggtgagctccgggccggggtgactaggaagagggacaagagcccgtgctgtcactggacgaggaggtggggagaggaagctctaggattgggggtgctgcccggaaacgtctgtgggaaagtctgtgtgcggtaagagggtgtgtcaggtggatgaggggccttccctatctgagacggggatggtgtccttcactgcccgtttctggggtgatctgggggactcttataaagatgtctctgttgcggggggtctcttacctggaatgggataggtcttcaggaattctaacggggccactgcctagggaaggagtgtctgggacctattctctgggtgttgggtggcctctgggttctctttcccagaacatctcagggggagtgaatctgcccagtgacatcccaggaaagtttttttgtttgtgtttttttttgaggggcgggggcgggggccgcaggtggtctctgatttggcccggcagatctctatggttatctctgggctggggctgcaggtctctgcccaaggatggggtgtctctgggaggggttgtcccagccatccgtgatggatcagggcctcaggggactaccaaccacccatgacga

SEQ ID NO: 415657 - DNA, 829 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcctacagcgcctttgggacctgtgctacattcctaaccacagcaatagtaagaatcttgatgtggaatttttcaagagagtgcggtcttcctactacgtggtgagtgggaatgacccttgctgttgaggagcccagccgggctgtcctggacgcttggtgggaaggaaaggctcaggggggcagcaacatgcaggtgacactgatcccaactcatgactcagaagtgatgagggaatggtaccaggagacccatgagaaacagcaagatctcaacatcagggttttagcaagcagcagcacaggggttatgcaagatgattccttcctggcatgcaagatggacctgtaaaaaccagggccagccacaccacaggatctgaactttgtttccagaaattcttcaatttgaaatcaccttttctaaaaagtcaatccatctagtaaaggcgctg

SEQ ID NO: 415658 - DNA, 3636 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 415659 - DNA, 3152 bp, Homo sapiens
ccccgaggagaaggaggaggtagaagccagttgagcagaaatcctctcattaaccactgcgtcacggtgtagtggaagggtgggtgttgtggctttttccctgtgacacacacatccacactcgctcaccctgtgctcactcacggggtcggtgtgtgttatgtgtgttgggtgtgtgtgtgtcggtgtctttgtttgtgtgtctacgcctgtgtgtgtatgtgtcaccccgtaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 415660 - DNA, 2800 bp, Homo sapiens
ttgccccaactcccatggccaccaggactccatctcaggaggtgttttttctcagcccggggctgccttccagcagcaagtccaagggagccatgacccgagtttcccggtcactgacatgcttttttctccttcctctctctcttctgtgacctggcctccctggcctcaggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 415661 - DNA, 3582 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgatccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 415662 - DNA, 3656 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgcaaaaaaaaaggatttaaaaaa

SEQ ID NO: 415663 - DNA, 3539 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaagggagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccatatgcatgcaccagcacatgcatgacacatag

SEQ ID NO: 415664 - DNA, 3050 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccatgcgtggattgccagctggcaatccacgcatggcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 415665 - DNA, 2811 bp, Homo sapiens
  misc_feature (2724)..(2724): n is a, c, g, or t
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccatgcgtggattgccagctggcaatccacgcatggggccagtggcagggcaggttctccctgccagaacccgatcctagcccttcagaaggactggacctctgtgtccctncagtgggaagccaccttggacacacgcagtcattcaggtggacataagccactcttctcgcctgaccttgaggaactcaccagcgtt

SEQ ID NO: 415666 - DNA, 2225 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggtgaggacaggccctggggtgggagaggggatgttgaggggagctctctccccattctctgccccctctccacctgtacccttatcctgggttgagaactagacgttccacacatggaactaggtactgctgtggccagactgggtagcccagggcacaaacacagacccccatggacttaagtcaactcctggtcccccccccatttcctgaccccacggactactctcctagcccttcatttcatcccaaggggccacatggggcccttgaggagaggggcgcccccatcatttctcccatctggtcttcagcaagtaacaacccatttgcctcagtttctccatctctgcaaaccctcatcaaatctcccgggctctttctacccttaacactctggaaagcctgtgaaatgaaattattccacctcctgccctagccacccacagctctcctggtgctggtggcatcccccaaaacccactcccttcctacgtcctcccttggtctgagagttccctgctgtatgcctgcagggtgagctgttactccttgagggaacaagggaattgtcaactttccttctctactttttctcttccccgggaggtagagagggaggggtaatagaagggaacacattaaaaacacataacagtggctcatgcctgtgatcccagcactttgagaggccaaggcaggaggattgcttgagcccaggagtttgagaccagcctgggaaacatagggaggacttgtctctaccaagaaaaaaaaaaattagttgggcatggtggtgcacaccactgtggtcccagctactatggaggctttagtgggaggatcgcttgagccgaggaggtccaggctgcagtgagccatgattgcactattgcactccagcctgggggacagagcgagactctggctcaaaagcaaaacaaaaccaaccacataacgattgttcattcattcaacaaacctcctgcacaccagaaacttccccataaacctggccccttctgtaccatcctttggacagatgtgatggtcctgaaggcagactcacgctggatc

SEQ ID NO: 415667 - DNA, 547 bp, Homo sapiens
tcaggcagtgcgtctgggtagcatggggctgcgcttccccctacgcaacatctaggttcttaggaaacttcagttgttgtaaaaatcggaaatgaaaagacagttggtgccatgcgtggattgccagctggcaatccacgcatggcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgca

SEQ ID NO: 415668 - DNA, 2729 bp, Homo sapiens
  misc_feature (2594)..(2594): n is a, c, g, or t
  misc_feature (2600)..(2600): n is a, c, g, or t
  misc_feature (2608)..(2608): n is a, c, g, or t
  misc_feature (2618)..(2618): n is a, c, g, or t
  misc_feature (2626)..(2626): n is a, c, g, or t
  misc_feature (2632)..(2632): n is a, c, g, or t
  misc_feature (2634)..(2634): n is a, c, g, or t
  misc_feature (2638)..(2639): n is a, c, g, or t
  misc_feature (2642)..(2642): n is a, c, g, or t
  misc_feature (2649)..(2651): n is a, c, g, or t
  misc_feature (2655)..(2655): n is a, c, g, or t
  misc_feature (2663)..(2664): n is a, c, g, or t
  misc_feature (2671)..(2671): n is a, c, g, or t
  misc_feature (2694)..(2694): n is a, c, g, or t
  misc_feature (2706)..(2706): n is a, c, g, or t
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctctgtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcctaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttaggtctacctggccaggtagacctaacccagatagacctaacgagctaaaaaaaaaaaaaaaaaaaaaaaaatctcctggggattaaaaaaagcttataanttggtntggggccnctttcaaagntgccctgncccccngnttgnncangcttggnnnaaanccaaagcnnttggaanacaggatgcagggcaggaagtanggcctctgccanaactctttaagccaggtgccatg

SEQ ID NO: 415669 - DNA, 309 bp, Homo sapiens
cagcccgagcccggcctaggagaccccgagaggagacggtgagtaagggacatcagaacttggcctgggtagggggaagcaagagaggcaggaagtttcttatgaatggaggggggctccactaaggcctcagtgttacagaaaccccaagatccttgctacacgagcgaggaccggaggcttgttttttggctcttgggggttctgaaagaagtagaggttcgggatgggtggaggagtgctgtatccccaaatctcatggcctctatctccctgactcagctcaccccagaggaagaggagaagcga

SEQ ID NO: 415670 - DNA, 647 bp, Homo sapiens
tttggcttttctatcctagtccccattttttgacagttgaattcacattcttccagtctctgagattagaaaccttgcagacatctgttaactcttttctcttcatcaaccccattttcaatctgtcattgagttcttttgttcttcagagtttctcttaaatttgtctttttctccccattctctattccatgactctagtccagtcacttatcactttgtacctgaattacagcaaccgcctcatattttgttttctgtgtcctgtttctctcttcagttaacaccgaagtagcagctactttcctagtatttcctattactgaaagtctaaatttgttacaaagaccttttatggctggacctggtggcccatgcctgtaatcccagcacttttggaggctgaggcagaaggattgcttgaggtcaggagtctgagaccaggctaggcaacatagggaaactgtgtctctacaagaaaaaaacatttttttttaagtagccagacctggtggtgtgtgcctgtagtcccagctactcaggaggatgaagtgggaggattgcttgaagcccaggaggtccaggctgcagtgagccatgaccctgtcactgcactgtagcttggggacagagcaagaccctgtctc

SEQ ID NO: 415671 - DNA, 1936 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactac

SEQ ID NO: 415672 - DNA, 2278 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactac

SEQ ID NO: 415673 - DNA, 809 bp, Homo sapiens
cagagaataaagtgggggatggtgagtagagtctgggacaaagtagctggagaagaatctagaaagtaggttggggttaatgtgtgaggggggccataaatgcctgttctgttatgggcagtggggaaccattgaagattttctggtggggcagtggtatgatcagacctgtgttctttcttccaaccagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaaggtactggttttcctgagtagtgctatagtgggacccctgccgtcctcagggcactattgccaggggctcacagagatcctcactgaggccacagacttgaagaagttgaattgcttttgagaacccttaaaaatctccaagtagacccagcttcactgaaatgcaatctcagaattatgctcacctaacctccctttctttggttataggtttttctctataggctgagcttttgtcctgactaataattataactcaggagtgccaaagtcctccaggccacgcataccatgagagcattctatctcctacctctcccactagatttttccatcccagcatccacctgcccttattactgcatgttccaagttgaaagctaaatccttgtctttttcacatgctcaggttatggcctactcactttaatcctcaaaagctgcctgttctcctcaagacagggacttgcctttc

SEQ ID NO: 415674 - DNA, 3248 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtccc

SEQ ID NO: 415675 - DNA, 2720 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtccc

SEQ ID NO: 415676 - DNA, 3052 bp, Homo sapiens
cagagaataaagtgggggatggtgagtagagtctgggacaaagtagctggagaagaatctagaaagtaggttggggttaatgtgtgaggggggccataaatgcctgttctgttatgggcagtggggaaccattgaagattttctggtggggcagtggtatgatcagacctgtgttctttcttccaaccagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtccc

SEQ ID NO: 415677 - DNA, 2917 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtccc

SEQ ID NO: 415678 - DNA, 3062 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtccc

SEQ ID NO: 415679 - DNA, 2906 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccagctggaaagggctacccctgcaaaacatgtaagatagtgctgaactccatagaacagtaccaagctcatgtcagcggcttcaaacacaagaaccagtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtccc

SEQ ID NO: 415680 - DNA, 3154 bp, Homo sapiens
ggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcaccaacacccagtgtaaggtttgctgcgccttgcttatttctgagtcccagaagctggcacattaccagagcaaaaaacatgccaacaaagtgaagagatacctagcaatccatggaatggagacattaaagggggaaacgaagaagctagactcagatcagaagagcagcagaagcaaagacaagaaccagtgctgccccatctgtaacatgaccttttcctcccctgtcgtggcccagtcgcactacctggggaagacccacgcaaagaacttaaagctgaagcagcagtccactaaggtggaagccttgcaccagaatagagagatgatagacccagacaagttctgcagcctctgccatgcaactttcaacgaccctgtcatggctcaacaacattatgtgggcaagaaacacagaaaacaggagaccaagctcaaactaatggcacgctatgggcggctggcggaccctgctgtcactgactttccaggtcaccaaaaacagtggcatcatccctgggccagattccaatgcaaaggcaacccattcagaaagactcaaccaccttggaagactagaggtgattctgcccagcatcccatattgggccagccatgagccagcttcccgtgactgctcagcccttggctccctcttgctcgttgttctcaccaggaaagtacacgggcctgaggcaggattgggccacagacagcctctcattggtccgggctaattcactcctgctgctcccctttggcaggggtcctgtaggtcatgacaggggaggcaagggtattgagagactcggggtctcgcggggtggtagtttggagggtggctttccccatttcccaacccctctgggccttaggtgctgaggcccctgccacctgtctttcctctaaaggtcagttttgggccagttcttgcaactaaagagcagagatctctctgggccctagacatttccagcaaaacctggaactttcatgccaaacctggggcagggcaggaaacagaggaaatggctgcaacatgggagcttggagctaatacgacactctgccttcccccagaaggtgcaggctttcctgagtcttagaccagatatggccagttgcgcaggtttctgccaactgtgaagtatcctcctggagcagtgacacaatcttggcggagcattgctacccccgctgccccctccacagttcctgaatggtgctaaggatctgcagcagttggcaacgagctggggctgggggcggcctccatgtccactgagatcataggacactccaatggggatgggacctttcccctcctccatcagaggtgctctgaccctaggttacacgggaaagtgccccacatgcaagtctccctgagggttctgcccctaaaggcagactgcctcatgcccgctagctgtgaggttcattgctaccctcggccctactagccctctcttcccccttgtgcagcggaccacttgcccagtttgctgtggtgctagccttccccatcatccaccgggtgatttctgggtcccagggaaagaaagagagagctgatgcaggtttctacagtgaggaacaggcgtttcccaggccccacacccagatttctctatctttgctgtgttttatggcctgggactgagtccacacggatagatttttccttgtaaccttgagacgagaattccaaggagtgtcaccatcagaggcttctcttcattgtgtcaaagaagcccctagctgctctcgtggcctccttcccccactccctatcccttcacctgtgaaatgcctttgctttgcatattgtgtgtggatgtgtgtgtgtgtgtgtgtgtgtgtgtgtgtgtatgtgtgtgcttctgtgtgtgcctaatgctctgtctcttggtcactgaagcatccaaataaagaatttccctcatgggccagactacaacttaacagacctagggttttgagccatattgccattggatctagtatgtctgtcttgacccctcacccccaccccattcagacctcagtagtccccagtagtcactttaggagttgggacagagtcgagcaccctgtgaaagtctcccttgagttcaggtgccctgaactcagtacagcctcatcttctcatccaccaccttctcctgcttctcctgtcacatagggcctcatgaaggtctttaaagggtttaagctggggatctgctttatgtttgagagaactgttctggctgttatgtaaaggagtgcagggaggggcaggaaaggagacaaggaggccagtatggacactgtgtccagtatggctttccaggctaatcacttagggcagagacccagccttattcatctctacttcctgatgtccatagtggtgtgtcatgaatttttattgaatgaacaaatgaggtgtatgaggagagatggttttctcctgctcagctcttacacagtgataggtttgttccatgggacttatcataggcctggtgattcttgaaagagcatttttcatgactcaaaaatgagctgagaaggagtgttatggccaggtgcggcgtcatgcacctatagtcccagctgctcaggaggctaaggcagaaagaccattcaagcccaggagttccagcctgaagtatgctgtgatcatgcctgtgaataaccactgcactccagccagggcaacataacaagactctatctaaaaaaaaaaaaaaattataaaaataaatttgaaggctgggcgccgtggctcacgcctgtaatccaagcactttgagaggccaaggcaggtggataacctgaggtcagaagttcgagaccagcctggccaacatgatggcaaaaccccgtccctataaaaaatacgaaaatcagctgcgcctggtggcacacatctgtagtccc

SEQ ID NO: 415681 - DNA, 330 bp, Homo sapiens
agaaaacaggagaccaagctcaaactaatggcacgctatgggcggctggcggaccctgctgtcactgactttccaggtgagggggcctagctcacacccagagctggaccagggtttggccactggggctacccggaccagctgacgttgtgcttttcctccttaggtcttgtaagtagggtttgcgaactcagatggctacagaagccagatgagaaattaaaatgagagccaggaaggggatatggtcagctgaagagtgaatgccattcctactcagctgttaccatatctttcaggttttcttttctttttttttttttttttttt

SEQ ID NO: 415682 - DNA, 274 bp, Homo sapiens
ataaggaggaaaactatagctctagtggacatgctgtatcccagtggttctcacctgggaaagattttacccaggaagggacatttggcaatgtcaggagacatttttggatgtgacatcaggagtaggggaggctaatggcatctaataggtaggggttagggatgagccaaaacatcctacaatacacagcatagctctccacagcaatgattcatccagcccaaaatgtcaagagttctgaggttgagaaaccctatgttaaccaggttac

SEQ ID NO: 415683 - DNA, 1791 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggc

SEQ ID NO: 415684 - DNA, 629 bp, Homo sapiens
cttggcccaccacctggtgactcccgtccacagctcccagctaccatgatgagccctggcggcttgagcacagtgagtgctggcaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415685 - DNA, 456 bp, Homo sapiens
catccgtctttccatgcagggccacccccctctacttcaccccagaggctcagacgagccctccccatcattccgcagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggc

SEQ ID NO: 415686 - DNA, 1854 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggc

SEQ ID NO: 415687 - DNA, 2283 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagagcttccagaagcctctgttttctgttcttctccctgtgactcttagtgattctgatgcaggaagtgtgcccggtggctctgctgccgtcactcctctaggaagatgtgggggtcatctccagagtgggtgggtggggcctgggtgactcagcacacatgcaaatcagagcaaaccaagaaaaccacgactgggcctgtaactgtggtctctctctatcccaaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415688 - DNA, 2300 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggaggtaacccagagtcccttccagaagcctctgttttctgttcttctccctgtgactcttagtgattctgatgcaggaagtgtgcccggtggctctgctgccgtcactcctctaggaagatgtgggggtcatctccagagtgggtgggtggggcctgggtgactcagcacacatgcaaatcagagcaaaccaagaaaaccacgactgggcctgtaactgtggtctctctctatcccaaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415689 - DNA, 2256 bp, Homo sapiens
cgcacttccggtggggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415690 - DNA, 1885 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415691 - DNA, 2173 bp, Homo sapiens
ggggcgggcagtaaacacgtgagcaaacaaggaaacgtcagaggtgggagtgccacgaggattgggaggggtggggcattggagaaagtattcagccaagcggaggtctgcggaagggagctgaaggcaggaagagcagcaagtaaagaaaaacacagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415692 - DNA, 2118 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctggtgaggccccagcgtctcttacccccgagttagctgccactgctccccatcctaccacgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415693 - DNA, 1990 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415694 - DNA, 2726 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctggtgaggccccagcgtctcttgtgtccttcctgcccccacagatgctaagaataaagtgggagtctgagcagtggcttgtcctgctgtgtgacagaggagacaagcccagtccaggtggcagtagatccctttctgagaagggacctagacatgggcaatactcagaatatttagaaaccagtgtggcagggtaatgaccaaaggtgaaagcactgcaggatgagggtcccagcagagctgggtctaggaagcaccctgctgtgggaggcagtagccctgtgtgttaggcccaggaggaggtgggaccacttgggggcctaggacagccgtcagtgtggcagagcaagcagggctgttggcataccagctgaccgtcagccctacatgctgacattggtgggcaaggactgtccaggaccccctgggatggagctgaagggtggaaggatttcttgccccaggggcagccaagatggctgctgaccccaggctccaaatgtgatgaacccttgaccctcaagacccccgagttagctgccactgctccccatcctaccacgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggtgagcacgtgccactcatcctccagagagaggaaccccggcacaggcagggcggaggcagggcagggccggaccagacctgatggtgcctgtcccccgccctgtaggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415695 - DNA, 2120 bp, Homo sapiens
cgcacttccggtggggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgcttccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415696 - DNA, 1927 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415697 - DNA, 1184 bp, Homo sapiens
tgggtgcagtgtgactgtggacgggagtcaccaggtggtggggccaagccaggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415698 - DNA, 1416 bp, Homo sapiens
cgcacttccggtggggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtgagtactggccatgccctgctgcctcccttcaggctgaagctgtctgtctgtccagcggggtgtctgcacacccggctgctaggccagccactccaccactctgggaccagcccttgctctctcagcctctccctggcacccagcagctctccgggaagtcgccagcctcttccgtaagcccagcgcagaggagatgctgtgcccacctgccaggcagcgtggggaagccagggagctctcccagaaccccatcatcagagcaggggaaggcaggctgcaaggccacagacaggtggccactggtgggtggtacacgcagccgcagcagagccctatgtggcctgggggctacacaagagtttcttcttccctctgatgttttgcttcagagagcactgttcctgccttcttgtcctcctacttctcatccttccttcccgctcctgggctctgccgagggttaggtaaagaacaggactcagggagctcaacgtcagacctgtaacctcttctctctggtgataaccagaggcctcttagtcagagattccttctgattaaaggtcgcttatcactcaga

SEQ ID NO: 415699 - DNA, 560 bp, Homo sapiens
taactgatgggtagttaggtttgaacggtctaaaggctttgccacactcgttacatttataaggtttctctccagtgtgaattttctgatgttgtgagagttgtgaatttcgactaaagaccttaccacactcattacatttgtaacgtttttcgccagtatggatcacctgatgggtagttaggtctacctggccaggtagacctaacaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415700 - DNA, 875 bp, Homo sapiens
tgggtgcagtgtgactgtggacgggagtcaccaggtggtggggccaagccaggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggaggtaacccagagtcccttccagaagcctctgttttctgttcttctccctgtgactcttagtgattctgatgcaggaagtgtgcccggtggctctgctgccgtcactcctctaggaagatgtgggggtcatctccagagtgggtgggtggggcctgggtgactcagcacacatgcaaatcagagcaaaccaagaaaaccacgactgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415701 - DNA, 670 bp, Homo sapiens
agagccatggctacggtgcccttcatgtttaacaggaaggcacaagcttcaaccagtctaactggaagccagtcacggctgggctggaacagggccctccaagcctgccgtgccagggttccccttcagtgtttggatccagggaaaccaaggagagcggggggtgtgaagggatgagctggggaaactggggctcaagcagcagctatttaccccactagagaagtatttcaatattttaataagtgatacaacgtagtgggccgcagtggctctcacttgggcataggccgtgaggaaggctgggcaggtagctcacaggtgtgttgaaatggtggagacagcaccaggctaggattgagtctcttggctgccacctgtcttcgtgacctaagagtctgtcattccaagcgatgataccgtaactaagggccctacacacatagcaaggtcctcatgaaccaccgaatgagccccactccagcagaggggcgaagaggaagagggagccggtggggggcaggctgtctaaaccaagccggggtgtctgctttgggctccatacagagcttccatttccccctcttcatgacgatgctgcacctggccgtgatcttcctcttctccgccctgtccagggcgctggttcagtgctccagccacagggccc

SEQ ID NO: 415702 - DNA, 2061 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415703 - DNA, 2257 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagca

SEQ ID NO: 415704 - DNA, 3182 bp, Homo sapiens
ggggcgggcagtaaacacgtgagcaaacaaggaaacgtcagaggtgggagtgccacgaggattgggaggggtggggcattggagaaagtattcagccaagcggaggtctgcggaagggagctgaaggcaggaagagcagcaagtaaagaaaaacacaggtttgatgtgtttgacacgtggcagggggccgctgtggcgggtgctgggaccagtggcagaagaatgaggttacagaggccttccttgtggaccaggctgaggagctgggcttagccttagggcatgatctgtttcgtgtgccatctctctggctgctttatagattccaggccttaggggcgaaagaggaaacagggagaccagttagaccagtggcagtcagcaggtgaaagataattgtggcttagactgtggtagtgggaatggagaggaagagaagtagaggggtcaagaagtgtattgaaagtggaactgacagggcaggatttgagaaatgacagaaataagtggtcaaagatgacttcatcatagatttttggttttggcttaagtaaccaagtgtattatgctggcatttactaaatgactttgggatagattgggagcgtgagaaataattacgaaatcttcttagggcatcttaagttttagatatttggagtgcagctaccaaataggcagttagatatatgagtctgatacagaaaaggtcagggctgatgtaaagaatttagaaatcattggcaagtggattgggtaggatgagattatgtagggtaagatttaagagagaagagaagccaggttccaagctttaggcacccaatttttatagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415705 - DNA, 2468 bp, Homo sapiens
cgcacttccggtggggagattccggcctggagctcccagggccgagacaacgggaagaaagctggtgtgtttggggagctgaaaggcgcccagtggggccaggtcctggagagcctgtggctgagactgggaagaccagcagggccagatgaggccatgggagccgaaagaagggtgctggtctttatcagaaaagcactggaagctgctgaagggttttaagcagtggcctgacatgatcagtttgtgttttaaaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415706 - DNA, 2198 bp, Homo sapiens
cgcacttccggtggggagattccggcctggagctcccagggccgagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415707 - DNA, 2619 bp, Homo sapiens
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctggtgaggccccagcgtctcttgtgtccttcctgcccccacagatgctaagaataaagtgggagtctgagcagtggcttgtcctgctgtgtgacagaggagacaagcccagtccaggtggcagtagatccctttctgagaagggacctagacatgggcaatactcagaatatttagaaaccagtgtggcagggtaatgaccaaaggtgaaagcactgcaggatgagggtcccagcagagctgggtctaggaagcaccctgctgtgggaggcagtagccctgtgtgttaggcccaggaggaggtgggaccacttgggggcctaggacagccgtcagtgtggcagagcaagcagggctgttggcataccagctgaccgtcagccctacatgctgacattggtgggcaaggactgtccaggaccccctgggatggagctgaagggtggaaggatttcttgccccaggggcagccaagatggctgctgaccccaggctccaaatgtgatgaacccttgaccctcaagacccccgagttagctgccactgctccccatcctaccacgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415708 - DNA, 3514 bp, Homo sapiens
cgcacttccggtggggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtgagtactggccatgccctgctgcctcccttcaggctgaagctgtctgtctgtccagcggggtgtctgcacacccggctgctaggccagccactccaccactctgggaccagcccttgctctctcagcctctccctggcacccagcagctctccgggaagtcgccagcctcttccgtaagcccagcgcagaggagatgctgtgcccacctgccaggcagcgtggggaagccagggagctctcccagaaccccatcatcagagcaggggaaggcaggctgcaaggccacagacaggtggccactggtgggtggtacacgcagccgcagcagagccctatgtggcctgggggctacacaagagtttcttcttccctctgatgttttgcttcagagagcactgttcctgccttcttgtcctcctacttctcatccttccttcccgctcctgggctctgccgagggttaggtaaagaacaggactcagggagctcaacgtcagacctgtaacctcttctctctggtgataaccagaggcctcttagtcagagattccttctgattaaaggtcgcttatcactcagatgacagcccagctctgtttggtcatttcgctcagtgatttgtgctcctgctcctttctcggtgatgggtctgagccctgagctccagcagtgcattgtgggtaattttgcttccagggtacacaatgaccaaatcctcagctgtcctcttcatcttgatcttctctctgatcttcaagctggaggagctggtgaggccccagcgtctcttgtgtccttcctgcccccacagatgctaagaataaagtgggagtctgagcagtggcttgtcctgctgtgtgacagaggagacaagcccagtccaggtggcagtagatccctttctgagaagggacctagacatgggcaatactcagaatatttagaaaccagtgtggcagggtaatgaccaaaggtgaaagcactgcaggatgagggtcccagcagagctgggtctaggaagcaccctgctgtgggaggcagtagccctgtgtgttaggcccaggaggaggtgggaccacttgggggcctaggacagccgtcagtgtggcagagcaagcagggctgttggcataccagctgaccgtcagccctacatgctgacattggtgggcaaggactgtccaggaccccctgggatggagctgaagggtggaaggatttcttgccccaggggcagccaagatggctgctgaccccaggctccaaatgtgatgaacccttgaccctcaagacccccgagttagctgccactgctccccatcctaccacgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415709 - DNA, 2183 bp, Homo sapiens
cgcacttccggtggggagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415710 - DNA, 2636 bp, Homo sapiens
ggggcgggcagtaaacacgtgagcaaacaaggaaacgtcagaggtgggagtgccacgaggattgggaggggtggggcattggagaaagtattcagccaagcggaggtctgcggaagggagctgaaggcaggaagagcagcaagtaaagaaaaacacaggtttgatgtgtttgacacgtggcagggggccgctgtggcgggtgctgggaccagtggcagaagaatgaggttacagaggccttccttgtggaccaggctgaggagctgggcttagccttagggcatgatctgtttcgtgtgccatctctctggctgctttatagattccaggccttaggggcgaaagaggaaacagggagaccagttagaccagtggcagtcagcaggtgaaagataattgtggcttagactgtggtagtgggaatggagaggaagagaagtagaggggtcaagaagtgtattgaaagtggaactgacagggcaggatttgagaaatgacagaaataagtggtcaaagatgacttcatcatagatttttggttttggcttaagtaaccaagtgtattatgctggcatttactaaatgactttgggatagattgggagcgtgagaaataattacgaaatcttcttagggcatcttaagttttagatatttggagtgcagctaccaaataggcagttagatatatgagtctgatacagaaaaggtcagggctgatgtaaagaatttagaaatcattggcaagtggattgggtaggatgagattatgtagggtaagatttaagagagaagagaagccaggttccaagctttaggcacccaatttttatagattgagttgacaagaaggtgccagcaaaaaagaccaataaggagtccagaaaagcagaagaaaaaccaggagaatgtggtatcgtggcacccaagagaaggttttttctaggaggaggaagtgatccattgtgtaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagta

SEQ ID NO: 415711 - DNA, 1497 bp, Homo sapiens
  misc_feature (1443)..(1443): n is a, c, g, or t
  misc_feature (1484)..(1484): n is a, c, g, or t
cgcacttccggtggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctggtgaggccccagcgtctcttgtgtccttcctgcccccacagatgctaagaataaagtgggagtctgagcagtggcttgtcctgctgtgtgacagaggagacaagcccagtccaggtggcagtagatccctttctgagaagggacctagacatgggcaatactcagaatatttagaaaccagtgtggcagggtaatgaccaaaggtgaaagcactgcaggatgagggtcccagcagagctgggtctaggaagcaccctgctgtgggaggcagtagccctgtgtgttaggcccaggaggaggtgggaccacttgggggcctaggacagccgtcagtgtggcagagcaagcagggctgttggcataccagctgaccgtcagccctacatgctgacattggtgggcaaggactgtccaggaccccctgggatggagctgaagggtggaaggatttcttgccccaggggcagccaagatggctgctgaccccaggctccaaatgtgatgaacccttgaccctcaagacccccgagttagctgccactgctccccatcctaccacgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctncagaatcccatcgactgtattccatgccagcactgcccctngctcagatctgac

SEQ ID NO: 415712 - DNA, 781 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgaggcaagtgagggcgggagaaaggagcgagcctcgggctggggaaggcggcgtcattggccctccgggagcacggggccccgactccgacccggtctcccccgaggactcgcccccgccgcttcggctgcgactgtcccggtcgttcccggcagaagtggtcagcgagggaaagagaagtgacttctccatgggtttcaagctcccagctgttttgcggcagcccgtacggttccctcccgggatcttcttccctcctttctgcttccctctgcttcccctttcatctcttggcgctggaagagttaaaccgacgccagctttagctccttggcttcgtggctacggcgttcttagcctcccctgctcgggctcttcccgtcgttttgggttgagagaccacgaggttgctaagctctggacaccgcttaggcgtccttttagttcttcgactccagc

SEQ ID NO: 415713 - DNA, 3729 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcctttgataaaatacagcagctaaaattctctcagattgtgaatttgaaaggtaaaggacatggcctgtctatcacacctctgccagctggtcatatgataggtggaacaatatggaaaatagtcaaagatggagaagaagaaattgtttatgcagttgacttcaaccacaagagggagatccatttaaatggatgttccctggaaatgctaagcaggccttccctacttatcacagattcattcaatgctacatatgtacagcctagaagaaaacagagagatgagcagcttctgacaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggtta

SEQ ID NO: 415714 - DNA, 3316 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcgattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggtta

SEQ ID NO: 415715 - DNA, 4172 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcgattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacaaagggaaacacctgggccacacatatgccgatgttcagtggatgactgctacgcaagcaacataaagaggccattttatgaaagggaacatcagaggaaacattataactgagacctttatagcctttccattattatggtttaaatccttgacagtctttatttgcaatgacactgggaccagtaaagacaaaggtacacccgggtcctc

SEQ ID NO: 415716 - DNA, 4351 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcgattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415717 - DNA, 5650 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcctttgataaaatacagcagctaaaattctctcagattgtgaatttgaaaggtaaaggacatggcctgtctatcacacctctgccagctggtcatatgataggtggaacaatatggaaaatagtcaaagatggagaagaagaaattgtttatgcagttgacttcaaccacaagagggagatccatttaaatggatgttccctggaaatgctaagcaggccttccctacttatcacagattcattcaatgctacatatgtacagcctagaagaaaacagagagatgagcagcttctgacaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415718 - DNA, 3620 bp, Homo sapiens
gtttcatgtagctttggcatgtacagttgatgccacaagtgagtcttttaacctcacctggtagatgtgagtttcactagtggcatcaactgttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415719 - DNA, 1778 bp, Homo sapiens
ctccccctcccaagtagctgggactactagtcccccacgtagctgggactaacaccacatctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415720 - DNA, 1640 bp, Homo sapiens
gtgtggcgatctagaggatcccgtctgtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415721 - DNA, 822 bp, Homo sapiens
ggctttgttaaataatgttaaataatggggtaaaatttagaataacaacttggaatgtgatttacagtcttgaaatgatctgtcaaaggacttcagggaataatagaaaatctcttagagataatgtagtattttactttattcagtacagttgtatgtctggtgttttacttgaagttattctttcccctttgaccttatctaaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagagtaagtgtgttttcaataagggctgaattgaacacatacgtctgatgttttgtcattttgaaattctgtaattcttgtttggtattttcacaaaactgaagatcagtaatttatattcatgatcatgacctcaaaggcttacagaagtcttattgacttgaaggcttatgaaagactcttgaagaaatgatatataattttattgtaaattttaattatttgaatcttctgacatttatgtctatgtaaaattcatgacttcaatattatatccatatgctgtgaatcagagcaacccatgtcctgaccaatcataaagtaatctatttcatatatttcggttattatgtctgcatattaatgaatagaaaatgtactaaagaattttttttatttggtttctagacggaaactggacgcattggattagaaggctgcctttgtcaagatttttataggataagagaccttttatatgaac

SEQ ID NO: 415722 - DNA, 5803 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcctttgataaaatacagcagctaaaattctctcagattgtgaatttgaaaggtaaaggacatggcctgtctatcacacctctgccagctggtcatatgataggtggaacaatatggaaaatagtcaaagatggagaagaagaaattgtttatgcagttgacttcaaccacaagagggagatccatttaaatggatgttccctggaaatgctaagcaggccttccctacttatcacagattcattcaatgctacatatgtacagcctagaagaaaacagagagatgagcagcttctgacaaatgtcctggaaacacttcgaggtgatggaaatgtgttaatagcagtggacacagcaggcagagttttggaacttgctcaacttcttgatcagatttggaggactaaagatgcaggattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415723 - DNA, 5224 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcgattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415724 - DNA, 3712 bp, Homo sapiens
ctcctctcattttttttttttttagcttccaaacattaccaataatttctgaataaaatttcgctccagacagacgaggcgtgcaggcgtgaccccgtcgccttccgacagcaccgtgcccaccccccggagatggtctcgccctggttcctcctcgtctccgccgctagtctccagctccaaaatggcggctgccactgtggggcttctgccggccggtagtccctggcgctgctgacccagcatcggcttttctacgtcttgaacctggattcgcctaggggttgggaagggctgtggacggcgttgggggaggcctgacgagattaataaagaactcttcagaattcctggtgtttcatcatatatacgactaagatatcaactcttctagcttgctgtttctggaccaaaaaaaatgacgtctattatcaaattaactaccctttctggggtccaagaagaatctgccctttgctatcttctccaagttgatgagtttagatttttattggactgtggctgggatgagcacttttctatggatattattgattccctgaggaagcatgttcaccagattgatgcagtgctgttgtctcaccctgatcctctccaccttggtgccctcccgtatgctgtcggaaagttgggtctgaactgtgctatctatgcaaccattcctgtttataaaatgggacagatgttcatgtatgatctttatcagtctcgacacaatacagaagattttacactctttacattagatgatgtggatgcagcgattgggtgtttactcattggcactcctaaataatgtcagttacaatgtggtggagttttctaagtcccaggtagaatggatgagtgataaattgatgagatgttttgaagacaaaagaaataatccgtttcagtttcgccatctctctttatgtcatggtctttctgacttggcccgtgtacctagccctaaagttgtacttgccagccaacctgacctggaatgcggattttcaagggatctctttattcagtggtgtcaggaccctaaaaactcaatcattctaacctacagaactactcctgggactttagcacgtttcctaattgataatccttctgaaaaaattacagaaatagagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttaaaaaaaaaaaaaaaaaaaaaaaaaaaaaaaaaaaaaaaaaaaaaaaaaggggggggggctaaaagttttccccgggggggcccaatttaggctgttcaccccgtgtttttgttgttacaaaggggggcgccccttaatggaaggagatgcatatttataagagaaggcaaaggggcgcgcggggttgtaaaaacacggctcgttgacgtggggaaaaactcgctgtcttgggaaatctttggggggagagggaacccttttctttctgtggggtgttgacaaatcttttgggcacttccctcggagaattttaagtctaggcaaatttaacttctgaggtgtatgggtgtaccaagcgttgttgtggtgaaaattgttccgggctatttgaatata

SEQ ID NO: 415725 - DNA, 4591 bp, Homo sapiens
ttattcctagagacagagtcaacctatgttgcccaggctggtcttgaactcctggcctcaagcagtcctcccacagtgctaggattataggtgtgagctactgtgcctggccaaccagtttgatttaaattaaacccattctagatgatgtgtgacagctcaattttaatactaatctaaataggacctataattgtatgtaatggaaacttgattaatttcagaggaaacaatcagtttaaagatgatagagcaatttagagatgtgatgtatctcatatcccactgctttaaccccctaatattaacatattaacatttccttttgtcttttatttttttttagttgaggaaacgtgtgaagcttgaagggaaagaacttgaagaatacttggaaaaagagaaactaaagaaagaagctgccaaaaagcttgagcagtcaaaagaggcagatatagattccagtgatgagagtgatattgaggaagatattgaccagccatcagctcataagacgaagcatgacttgatgatgaaaggtgaaggcagtcgtaaaggaagttttttcaaacaggcaaaaaagtcctatcctatgtttcctgccccagaagaaagaattaaatgggatgaatatggagagattatcaaaccagaggatttcttagtgccagagcttcaagctactgaagaagaaaaaagcaaattagaatctggtttgacaaatggagatgaacctatggatcaggatttatctgatgttcctactaaatgtatttctacaacagagtctattgaaataaaagcccgggttacctacatagactatgaaggacgctctgatggggattccattaaaaaaatcattaatcagatgaaaccacgacagttgatcatcgtccatggcccaccagaggccagtcaagatctggcagagtgctgtcgcgcctttggtgggaaagatattaaagtgtacatgccaaagctacatgaaacagttgatgccactagtgaaactcacatctaccaggtgaggttaaaagactcacttgtcagctctcttcagttttgtaaggcaaaagatgctgaattagcttggatagatggtgtcttagatatgagagtttccaaagtggacacaggggttattttagaagaaggagaactaaaggatgatggagaagactcagagatgcaagtggaagctccctcagattctagcgttatagcacaacaaaaggccatgaaaagtctgttcggagatgatgaaaaagaaacaggtgaagaaagtgagatcattcctactttggaacccttgccacctcatgaggttcctggacatcagtcagtttttatgaatgaaccaaggctgtcagacttcaagcaagttctcttacgggaggggattcaagctgaatttgtaggaggtgtacttgtttgcaacaatcaagtagcagtccgcagaacggaaactggacgcattggattagaaggctgcctttgtcaagatttttataggataagagaccttttatatgaacaatatgccattgtataaaggacatgatgtcaagaagtatctgcttgacctttctaagaaaaagggattcttatcttactctgagcttttgatgttttgttttgtaacatacaaaaagaatctgccagaaaaacttacatgtatcagatttttaaaaatataaatagagaacattttgcaaatgctcaaatgagcattctatcttttggctttcagagtgatagagctcctaacaggtgtacaggcccaagagttgaaggtgattggttttctttacagactccttgttctctagaagggctttttacttgaataaaacaatgcaacttagcaaaccaatttatggccttagagaaacatttttgcatgagttcttacaaactgtttgttatattttctggaatgataagtgagaattatttagaaaagacatgctccaaaaaaaaaacaaaactgataaaacagtttttcgaaacttacttttaaaagcatacgtgctatgactctctccagtttgaatatgcaattgttttcacaggcaggatgtctgttttctgcctgtatttcccagtgatttactctagggtaaggtagtacacatttggttcagaaattaatttttatttctcctatatcttgttttatcaagattttgttgtggcatttcaatgtaaattataacaccatcatttgagtatacataattcaaaagaactacttgatgcagtatagtcttaagggttctgcatacattttagaaacatcttagccgtaagttaggtcctgtgttaaactgtttagtgctctgtttttaagaaaacaaatgttgaacctcacacttttatgtggtgacagtgtaatttaattaaaaggtgtaaatgttttcatctcttaggcttgctgtctcctaaggtcacccaagcagtggttggattttatacacattactactaaaataatactgaagttggataaggttatcctttctgtatttgcgtctttcttgtgactaaccaccctgatatagtattaaccactgtgttcaagagtaaaaacaatatatgcaattttcattgaacttaaagagtgaaaaccatgtaaactattgaaactattgtaatccattaatgcttttttagaatggcagaccttgatgtttatttctcaaatggttaagccctcttctttactcttaatttttttttgagacagagtcacccaggctggagtgcagtggtgagattttggctcactataacctcttcctccagggttcaagtgattctcccacctcagcctcccaagtagctgggactacgggcacatgccactgcacctggctaatttttatatttttggtagagacagggtttcaccatgttggccaggctggtctcaaactcctgacctcaagcgatccacccacctaggcctcccaaagtgctgggattacaggcatgaatcaccacaactagcctacccttagatttttggaaggatcgatcttatttaactatgtgtggaacaacccagtaatatcagactcgaattactatttcattctatttcaaatgcttataaagctactattgtagattatagtgttaatgcaaagtttacagacttttgatatggaaaaccagataaaacaacaatgttacaaaaggcaaatataaagagtatgttttctttttagtgctttggaaaaatttcacttaaactcttattactgtatagattaagccctataatgctatttatattccaggggaacgaaaatctgaatttgttttatgatttaaagcatctggtttgcatattgtattgtaatactgatacagtttggctgtgtccccaccaaattgaattgtgttaatagttcccataatccctacgtgttgtgggagggacccagtgggcagtaatttaatcatggtggtggttaccctcatgctgttcttgtgatggtgagttctcatgagatctgatgggtgtttttttttgttttgttttttgttttttgagatggagttttgctcttgttgcccagactggagtgcaatggcacacgatctcggctcaccgcaacctctgcctcctgggttcaagcgattctcctgcctcagcatctcgagtagctgggattacaggcatgcaccaccacgcccagctaattttgtatttttagtagagacggggtttctccatgttggttaggctggcctcaaactcccgacctcaggtgatccgcccgcctgggcctcccaaagtgctgggattacaggcgtgagccactgctcctggcccaagatctgatggttttgtaagggaattttccccctttgcttggcacttcttcctgctgccatgtgaagaaggatgtgtttgcttccccttccaccatgattgtaagtttcatgaggcctccccagcctgtgggactgtgagtcaattaaacgtgtttactttataaattacccagtctcaggcaattctttatagcagtgtgagaacagactaatatgaataccaatactgaaaaattgtttcttgcctcaccttgtcctatgaacaggaattaaattttaaagtattgccttaagatggctgtgctaaataataatcattgcaagagcaatacttttacctgtttctagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggcttttttaaaaaattgaga

SEQ ID NO: 415726 - DNA, 229 bp, Homo sapiens
  misc_feature (216)..(216): n is a, c, g, or t
  misc_feature (224)..(224): n is a, c, g, or t
cggagaatgaagatacaattgatgtgttccaacagcagacgggaggtgtctactgaaaagggaacctgcttctttactccagaactctgttctttaaagaccaagattacattctcaattagaaaactgcaatttggttccaccacatcctgactactaccgtatagttttctctattctttcatttccccagcccctcccccggccattcacgcntccggtcnggctg

SEQ ID NO: 415727 - DNA, 413 bp, Homo sapiens
tatagttttctctattctttcatttcccccttccctattcctttattgtacataaagtaactggtatatgtacacaagcatattgcattttttttaactaaacagccaatgatatgttttgattgacatcaagtggagatgggatggggaaaaatactgattctgtgaaaataccccctttctccattagtggcatgctcattcagctcttatctttatattccagtaagttattttgctctcactgttttaacaaaaacaacaacaacaacaacataaaaatccttgcatacctttttcaattggagaattttaatgattttcatttatcattgtaaaaccaaggacaattttataactttttcgtacatagctgctacatgtagggcaatctgtctttaagtagggataaa

SEQ ID NO: 415728 - DNA, 236 bp, Homo sapiens
aagcttcctctcttacaaagactttacctcagcatgccagaaagagtgagcccctacagtgcatgtatatttctgaagattaactagagactaggcaaacactaaattattaagagccaaactgaacaccaataagaaagagaagcaaaattttaaattctaattcaaatgatatactatgatatccacttctaatatattttaagttccagtactgacagtgtttggattttttt

SEQ ID NO: 415729 - DNA, 1484 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaa

SEQ ID NO: 415730 - DNA, 374 bp, Homo sapiens
tatcccacgccgcaccgccggttcaaaggtccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgaaccgcgtgcgcgtggggatctctagatcgac

SEQ ID NO: 415731 - DNA, 265 bp, Homo sapiens
tataagatctgtctagattcattgggtcctcaattttttgctggctattggccagaggctgttcttagttacttgtctcttgggccttcctgacatgactgcttgcttcctcaaagccagcaagggagtgtgtctcctagtaagacagaccttatagtcttaggtaatatacttatgaagtgacaacctgtcacattttctgtagtattctagtcacaggtcctgcccacgtgcaaggggataggccgaaaattggggagcctca

SEQ ID NO: 415732 - DNA, 1631 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaactaagctcttaagcacaagcgaacaacacaacacaacacacgcaggactccagagccggggtccgcacaaggggccacgaaatggcccgggctcccaagcgtgcccggacccgattgctgacaacggggaagatcgcgggagtaacc

SEQ ID NO: 415733 - DNA, 1351 bp, Homo sapiens
tataagatctgtctagattcattgggtcctcaattttttgctggctattggccagaggctgttcttagttacttgtctcttgggccttcctgacatgactgcttgcttcctcaaagccagcaagggagtgtgtctcctagtaagacagaccttatagtcttaggtaatatacttatgaagtgacaacctgtcacattttctgtagtattctagtcacaggtcctgcccacgtgcaaggggatagggagttacacaagggtgtatgtaccaggagacgataatttgtggttgtcttagagtctattcttcatgctctggattacttgaaaaatgggattatatttcttaaaaacctttggaaaacatgtcacttgttaagacaaatactcagttcttttggtggtataaagttagtggtttgagagtattcttccagactttttttctatgcatttagtaacataacttattgttttctgtgcctcattgtgtatcctgattgcttcttaaactgggttctaaatgataaaataacatccctatataagcatctttcttttccttttgtgtttgtataacattttacaatatataactttgtacccaataccttaaaaatcttttttcttttggaaccaggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaa

SEQ ID NO: 415734 - DNA, 1554 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcaggctagtctctaactcctgggttcaagccattctcccgcctcagcctcctgagtagcctgtgcttcacttggtacatcaggaacgtctctatcaagaatacaatttcagcaaggctgagggccatctgaaacagatggagaagatatatactcagcaaatacaaagcaaggatgtagaattgacctctatgaaaggggaggttacctccatgaagaaagtactagaagaatacaagaaaaagttcagtgacatctctgagaaacttatggagcgcaatcgtcagtatcaaaagctccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaa

SEQ ID NO: 415735 - DNA, 518 bp, Homo sapiens
tatcccacgccgcaccgccggttcaaaggtccaaggcctctatgatagccttaggctacgaaacatcactattgctaaccatgaaggcacccttgaaccatccatgattgcacagtctggtgttcttggcttcccattaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaa

SEQ ID NO: 415736 - DNA, 845 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagtatttcctttgaaagacctccctgtggatgactttaagcatgtccttgaatgtattgttatatcttacatata

SEQ ID NO: 415737 - DNA, 1038 bp, Homo sapiens
cttcctgtctctccactttctttccctctccgttttggtgggctggttgaagatgaaatccactgaggagggaagtccagcaccctgtgtgccagtccagaactggcccatctgtagaccccctgaaaatcatatgggcttggatttggatattctcaacagaaagggttaaaggctgatggtacctaaagcctggtacttgaattttgatcaagataagctgccttaagttctcttcattacacaaatgatcctagataattgatagatcctgtggttcaactggatttctagatagaagctggattcatgtgatgccagaggagtaaaatttcaagagactgaaaccagatctgagtttcgctgttccagtctggacctctttggtgctgtaaatcctggatatactgtagatgagtactgcgtttttcttttatggactctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatggcagtggtgagtttagtcgctcaccagctatctgtcctgcctgcaacagtaccctttctggaaagctagatattgtccgcacagaactcagtccatcagaggaatataaagctatggtattggcaggactgcgaccagagatcgtgttggacattagctcccgagcgctggccttctggacatatcagacatcaggaacgtctctatcaagaatacaatttacagccaactgatttttttacaaaagcaccaagaacgtgcattgggaaaaggacactttcttcaataaacgatgctgggaaaattggatatccacatgcagaagaatgaaatctgacccttgtctcaccatatgcaaattcaacttgagatggattaaagacttaagacctgaaattataaaagtactagacagaaaatctacggggaacacttcaggacatcgatctaacaa

SEQ ID NO: 415738 - DNA, 443 bp, Homo sapiens
ctctgaagtagattatatagataacaaatgaataaaattatgtttttcctttttttctgccctaggtaacaactccaagtttcctttggataatacacctgttcgaaatcggggcgatggagatggagattttcagttcagaccattttttgcgggttctcccacagcacctgaacccagcaacagcttttttagttttgtctctccaagtcgtgaattagagcagcagcaagtttctagcagggccttcaaagtaaaaagaatttgagccacgcatagtgtcacgcacctgtgatcccagctacttaggaggttgaggctgggaggatcacttgagcccaggagtctgaggctttagtgatctaagatcatgccactgcactccagcctgggcaacagagtgagaccctgtttctaaaaaaaaataaagataatttagctaa

SEQ ID NO: 415739 - DNA, 2621 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415740 - DNA, 2374 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415741 - DNA, 798 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggtgggatagagggtgctgatcttggagggtgggggagggaagcggctgggggctagggccc

SEQ ID NO: 415742 - DNA, 513 bp, Homo sapiens
atagtttatgctgtaatagtttatgctgtaatagtttatgctgtaatagtttatgctgtaatagtttatgctgtaatagtttatgctgtaatagtttatgctgtaatagtttatgagcataaactattctgaaaaacccagaggtgaagctggcagggctggcagccagggacagcctgcgcctggaggcaggcctctgcctgtatgggaatgacattgatgaacacactacacctgtggagggcagcctcagttggacactgggtgagctgggccagcactaaaggatagggtcctggaggtcagggtgacccttgataagactagccagcccatgactcatccaaaggttatgtagcctgaagccttcctgagcctcccttccctgaaggtgccactgtgcctttgcccattagaaactgcagatgttggccggatgcggtggctcacatctgtaatcccagcactttgggaggccgaggcgggtggatcacgaggtcaggagatcaagac

SEQ ID NO: 415743 - DNA, 2567 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415744 - DNA, 2729 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415745 - DNA, 2683 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgccagtctctagcttcattgttctctgttcacagggttcctgaaatgccaacccaatgcctgcctt

SEQ ID NO: 415746 - DNA, 3033 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggtgagagggctgggctggggttggagccaacctttgccttcctggcttcattgactgcttagcacagaggccataccaagaagaatgtgtggaaggtgtgatatttgtgtgccataattttaagttttgtatcttgccctcctcctacctaccacaaggctccatgggctagggacaagggcatcttctcccacttgcagagtaagacatgctcagggcttgttctggtccctgaataaggctttagtccagctttgagggatgctgggacctggatacttggtcactggctccctgggcccaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415747 - DNA, 2055 bp, Homo sapiens
aggaaggtgctaggtcctgtccagttccctggcagtccccccacacagagtgactgggggaggtcaggaaatcagaaggtggtcctttgccacgtgtagaaccaaaagactggttagtcactttgggtgggctggactgcactgtggatggcagggaggatgcatccttgcttagtagccttttggattgtagctgttgcaatggcctgaggctttcaatctcttccccagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415748 - DNA, 1982 bp, Homo sapiens
gcagcgtccagcccatggtagctgctcagtaagtggccccagatgctcttgtgtttctgtcttttaggacaaggtcagggagcttcagaaccagggcagagatgtgggcctggaggtgttggataatgccctgctagctctgcaaggtgagagggctgggctggggttggagccaacctttgccttcctggcttcattgactgcttagcacagaggccataccaagaagaatgtgtggaaggtgtgatatttgtgtgccataattttaagttttgtatcttgccctcctcctacctaccacaaggctccatgggctagggacaagggcatcttctcccacttgcagagtaagacatgctcagggcttgttctggtccctgaataaggctttagtccagctttgagggatgctgggacctggatacttggtcactggctccctgggcccaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactggggaagcgccgccgagctgctatggacttccctggagccaaggtcattgttccccagctgaagggcagggtgcagcggaggcgtgtggggttgatgtgtgagggggcccccatgcgggcacacagtcccatcctgaacatggagggtaccaagattggtactgtgactagtggctgcccctccccctctctgaagaagaatgtggcgatgggttatgtgccctgcgagtacagtcgtccagggacaatgctgctggtagaggtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415749 - DNA, 875 bp, Homo sapiens
gtcccgtctgaagctgtgactaaggagaggcgacggcagtgcggcggaagcagcagatggctgtagtcagcaagatgccctttgtgcccacaaactactataccctcaagtgaagctggctcagggtggggctgtcccttccaggagttttgcccctacaaggggttagtcaagaagctgaggcagaactcactgggggtgggcagttaaggtggaggctgattctaattgtctggttgaggggccacaccacctattccccccacctaactcatgccattccagcttccttcaggaccctgcttctgagtgacggaccagctcacacaatgtcttgtttcagtccatgatcccactgacctactcttgcctgctggagggtaatgagaagctttggttctgccatctctcccactctgccaggtgctggctgtggagcaaaggctcacctttgtggagaggataaaacctgcccaacctacctcaccatggtttttcacattgcaaagggtaataacatgggcagtgcggacttaggctaccccctccagtttgctttccgtaaatgcaaattgtccttactgcaagtcaggaatgattgctgactcacagtagggctgctatgcctgtgtgtaaacttggggatggctgagggaacatagactcactcttccacattcccaagttggtctagtgtgctgcccagtagcaaaccatggcagactcaccacctattctgagttccagggctgctgtagggcagggtgggcttcctcccagacttgccttaccctgggctgatctttgcccctggtatgcattaatggactccactgaatcctgaaaaaaaaattaaacttccttcttacttgcca

SEQ ID NO: 415750 - DNA, 1963 bp, Homo sapiens
agctgcttcggaaagcgtgacgaagcagtagtcctcagtgtgtgtgtaagtgaagaggaccttgtggtagcagggaccatgcttcattcgtggctgtgtccccatctgagggcctggtatgcagtaagatcaataaatacttgtggaatgcatgactgctggctgcctgtgtctgcctggtgggagagctgtggaactaggggtccacatgaggacagactactgtggtgctgcctacctgccaggctggcccaccttccccacccccacttgaccttactctcttgaggtcctaaaggtatgattcagacctttcagccctttccagaactttgaccctctggagacagggcggttctgcagggggcggtctagcccctagctttgttctgggcagcccaatcagctctggattgcccgagctgccctgaagagtcagccgaaagagctggaggcttcttccctgtggttgcgggttcctgcattctctgctctaaatcccagcctgcccttggggctgcccacgcccccttcagatcctttgctccggagagagacctgtccgagcagaggcctggactacatctcccggcgtgcctggcagtgtggtggcctctgtgcgccgtctgcactcgttgcaggcgacgatgcagagggctgtaagtgtggtggcccgtctgggctttcgcctgcaggcattccccccggccttgtgtcgtccacttagttgcgcacaggaggtgctccgcaggacaccgctctatgacttccacctggcccacggcgggaaaatggtggcgtttgcgggttggagtctgccagtgcagtaccgggacagtcacactgactcgcacctgcacacacgccagcactgctcgctctttgacgtgtctcatatgctgcagaccaagatacttggtagtgaccgggtgaagctgatggagagtctagtggttggagacattgcagagctaagaccaaaccaggggacactgtcgctgtttaccaacgaggctggaggcatcttagatgacttgattgtaaccaatacttctgagggccacctgtatgtggtgtccaacgctggctgctgggagaaagatttggccctcatgcaggacaaggtcagggagcttcagaaccagggcagagatgtgggcctggaggtgttggataatgccctgctagctctgcaaggtgagagggctgggctggggttggagccaacctttgccttcctggcttcattgactgcttagcacagaggccataccaagaagaatgtgtggaaggtgtgatatttgtgtgccataattttaagttttgtatcttgccctcctcctacctaccacaaggctccatgggctagggacaagggcatcttctcccacttgcagagtaagacatgctcagggcttgttctggtccctgaataaggctttagtccagctttgagggatgctgggacctggatacttggtcactggctccctgggcccaggccccactgcagcccaggtactacaggccggcgtggcagatgacctgaggaaactgcccttcatgaccagtgctgtgatggaggtgtttggcgtgtctggctgccgcgtgacccgctgtggctacacaggagaggatggtgtggaggtgtgtcaagaagtggtgtgggggcagtacagggcacaggatgcatgtgaggggttgggggtatgtggtacagggagcttcccatctgccctctggtgtttcatacagatctcggtgccggtagcgggggcagttcacctggcaacagctattctgaaaaacccagaggtgaagctggcagggctggcagccagggacagcctgcgcctggaggcaggcctctgcctgtatgggaatgacattgatgaacacactacacctgtggagggcagcctcagttggacactgggcctgggcgacagagtgactccatctc

SEQ ID NO: 415751 - DNA, 4517 bp, Homo sapiens
  misc_feature (269)..(269): n is a, c, g, or t
  misc_feature (407)..(407): n is a, c, g, or t
ccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccccccggacgccgggggggccgcgcgcancgccgctgttgctgccgctctcgctgttagcgctgctcgcgctgctgggaggcggcggcggcggcggcgccgggcgctgcccgccggctgcaacacgatgggcggccccgaggggctggcagggcggcgggcgccgcnggggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtccgccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtta

SEQ ID NO: 415752 - DNA, 3639 bp, Homo sapiens
catttctgtaatcatctgatactcttaggatgccactgaagaggaataactctaaataccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtccgccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtta

SEQ ID NO: 415753 - DNA, 2369 bp, Homo sapiens
acccactactggctgacccactactggctctggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtta

SEQ ID NO: 415754 - DNA, 4463 bp, Homo sapiens
  misc_feature (269)..(269): n is a, c, g, or t
  misc_feature (407)..(407): n is a, c, g, or t
ccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccccccggacgccgggggggccgcgcgcancgccgctgttgctgccgctctcgctgttagcgctgctcgcgctgctgggaggcggcggcggcggcggcgccgggcgctgcccgccggctgcaacacgatgggcggccccgaggggctggcagggcggcgggcgccgcnggggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtccgccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacatattcacccaatattgctctggaagcttatgtcatcaagtctactggcttcacggggatgacctgtaccgtgttccagaaagtggcagcctctgatcgtacaggactttcggattatgggaggcgggatccagagggaaacctggataagcagctgagctttaagtgcaatgtttcaaatacattttcgagtctggcactaaagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaatagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggatttgacgggatctgaactatacacccaggcggccagcctcctgcatcctgtggtttatactaccgctatcattctcctcttatgtctcttagccgtcattgtcagttacatataccatcacagtttgattagaatcagcctcaagagctggcacatgcttgtgaacttgtgctttcatattttcctaacctgtgtggtctttgtgggaggaataacccagactaggaatgccagcatctgccaagcagttgggataattcttcactattccacccttgccacagtactatgggtaggagtgacagctcgaaatatctacaaacaagtcactaaaaaagctaaaagatgccaggatcctgatgaaccaccacctccaccaagaccaatgctcagattttacctgattggtggtggtatccccatcattgtttgcggcataactgcagcagcgaacattaagaattacggcagtcggccaaacgcaccctattgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctacctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtta

SEQ ID NO: 415755 - DNA, 2860 bp, Homo sapiens
  misc_feature (269)..(269): n is a, c, g, or t
  misc_feature (407)..(407): n is a, c, g, or t
ccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccccccggacgccgggggggccgcgcgcancgccgctgttgctgccgctctcgctgttagcgctgctcgcgctgctgggaggcggcggcggcggcggcgccgggcgctgcccgccggctgcaacacgatgggcggccccgaggggctggcagggcggcgggcgccgcnggggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattggatctgacaaacaatcgaataggatgtctgaatgcagacatatttcgaggactcaccaatctggttcggctaaacctttcggggaatttgttttcttcattatctcaaggaacttttgattatcttgcgtcattacggtctttggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcgaccctccgcttgaattgccgtctttctacatgactccatctcatcgccaagttgtgtttgaaggagacagccttcctttccagtgcatggcttcatatattgatcaggacatgcaagtgttgtggtatcaggatgggagaatagttgaaaccgatgaatcgcaaggtatttttgttgaaaagaacatgattcacaactgctccttgattgcaagtgccctaaccatttctaatattcaggctggatctactggaaattggggctgtcatgtccagaccaaacgtgggaataatacgaggactgtggatattgtggtattagagagttctgcacagtactgtccgccagagagggtggtaaacaacaaaggtgacttcagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgtta

SEQ ID NO: 415756 - DNA, 1520 bp, Homo sapiens
  misc_feature (269)..(269): n is a, c, g, or t
  misc_feature (407)..(407): n is a, c, g, or t
ccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccccccggacgccgggggggccgcgcgcancgccgctgttgctgccgctctcgctgttagcgctgctcgcgctgctgggaggcggcggcggcggcggcgccgggcgctgcccgccggctgcaacacgatgggcggccccgaggggctggcagggcggcgggcgccgcnggggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattggacctccgaaacaatcttattagtagtatagatccaggtgccttctggggactgtcatctctaaaaagattgtaagtgtttgaattgcttgcttacgagtttgaattgttgcttatataaatagctgtcaacttactttaacatgatgaaaaatggacatttaataattttttgagctttacctggccaggtccctgatacagaaagaggctgggcacagtggctcacgcctgtattcccagcactttgggaggctgaggcgggtggatcacctgaggtcaggaattcaagaccagcctggccaaggtggtgaaaccccgtctctactaaaaatacgaaaatgagctggcatggtggtgtgtgcctgtagtcccagctacctgggaggctgaggcaggagaatcactggaacctgggaatgggagactacaatgagctgagattgtgccactgcaagacagagcgagactctgtctcaataaaacaaaaagaaagaaaaacaaagagtattttatataagtagctgagaaggtggttgatttgcacagtggtttgatttgtttggtggtggatggctgtgttactcttatgctactaaaatcattaccatgtcggctttgccggcgcacataatctgtagacgattttcaaattatgaatccattcaaactgtgtctgttgtaaatgccatataaacagaggtaccttttaagtaatgatttaaagtcttgctattttcatgtgtatctatatattacaattttaaaacctaaggaccagtttttattgcttctgaagctaaacaactcccctatctcctatacgaagctcctttcacagttgctgtctgagcaggcccacatttgagaagcggctctacacaaaagccatgaggactgtctctccatcctttatgctttctgaaagcgtttactgagcacttgccacttaccatgccctg

SEQ ID NO: 415757 - DNA, 770 bp, Homo sapiens
  misc_feature (269)..(269): n is a, c, g, or t
  misc_feature (407)..(407): n is a, c, g, or t
ccgggcggtagagcggcgctgggacccatgcggccgtgacccccggctccctagaggcccagcgcagccgcagcggacaaaggagcatgtccgcgccggggaaggcccgtcctccggccgccataaggctccggtcgccgctgggcccgcgccgcgctcctgcccgcccgggctccggggcggcccgctaggccagtgcgccgccgctcgccccgcaggccccggcccgcagcatggagccccccggacgccgggggggccgcgcgcancgccgctgttgctgccgctctcgctgttagcgctgctcgcgctgctgggaggcggcggcggcggcggcgccgggcgctgcccgccggctgcaacacgatgggcggccccgaggggctggcagggcggcgggcgccgcnggggcaaggtggtgtgcagcagcctggaactcgcgcaggtcctgcccccagatactctgcccaaccgcacggtcaccctgattctgagtaacaataagatatccgagctgaagaatggctcattttctgggttaagtctccttgaaagattgctgtacaggaagcatggagctggcatctgctcggcttctaaggaggcctcaggaagcttacaatcatggtggaaggccaaacttgcatgtcacatggcgaaaacagaagcgaggatgtgatgtcaaggggaaaaacactagtataaactttgatattttattcagatgtctttaaatgtgatatatttgtaaatatatatttttcttagca

SEQ ID NO: 415758 - DNA, 716 bp, Homo sapiens
gtgcgtgccagcagtaagtgaaagcaaggatcattttcagcctcactgctatccttatctcatttgcgtacagtaaatatctcaaagttgctagaataaaggtcttgtgcgatacctgggtgctgttcttgaatactgaatgcatgagaccttctttaaccaagagaactaattgaagacacttttccacccttctccttagggatctgacaaacaatcgaataggatgtctgaatgcagacatatttcgaggactcaccaatctggttcggctgtaagtatatcttttctttcccattaaaagataaggaagcatttgagccagtacctaaatatgtatgaaacttatgtatttaattataagtagcaactgtaggggttatagaagccataggggacaaggagctcacaatttaatcatggggatgtaatctcctcagaatataatgctaccttaccacaccacacacggacacatgtgcatgtacaccacacacacacaccaaataacacagtgtagtacatgcaacagagagcacgttcatgctgagcagtatgatcaaaagctttgctagtctgggaaaatttctaggaaatagtaaaatgtgagctgatggcccagaagatttgcagagatctggatagtgagaaaggaaaagaagccaaactaatgatacatgaaggtgggaatgagaacaaggccatttgtcaagggg

SEQ ID NO: 415759 - DNA, 534 bp, Homo sapiens
ttatgtactagcctgaatattaatattttctctcttttttaaacagtttgattagaatcagcctcaagagctggcacatgcttgtgaacttgtgctttcatattttcctaacctgtgtggtctttgtgggaggaataacccagactaggaatgccagcatctgccaagcagtaagtcagagtgaaaaaccgaaatggaaaaaattactggtattagaagataatttcattaactataaaaagaaaaaatcattctttaataccttttctttaactgattaaagttaaatttattgtctgtcacttaaacaatctgccagtttacttcctgttttaaattaccattttgcaactgaatatataacttaaacagctcatccctttatcattgggaatttagtgttacacgttatggctattattacaatgcctgttacttatttttaaaatgtatgaaattctgactttggctgaaagagaagtgacattttctgatagtagaattttaaaaattattttatgtgttgatgaaaac

SEQ ID NO: 415760 - DNA, 6705 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccagttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattctgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 415761 - DNA, 6688 bp, Homo sapiens
atgggatccttgcagggaatcgccaccaagattttgattagaattttgtcagatgctctgataagaaaagaaactgacctgaaaagactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccagttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattctgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 415762 - DNA, 5854 bp, Homo sapiens
ttacaaatttcacttgataatttacatggaaatatgaaagggttctttctccaagtgtcttgcaattgacttggaatcagcgagttaaacaaaagggactgagcctctaactctgggaatttcaaggctccagttacagcaaatgacatgctgtcccctccacctatgtctatgcaggtctgccttgggaaccacctcacacatcagtgccttcgctgtccatctgtgtatgttattcaaattcacataagttaagataaagatccaggatgataaaaaccaatcctgataggtgggattagagaattacttctttctgtagttaataacacaaagcaatcctgttcaggttctttggataagcctccctactttccttcttctgttcttgttctcccttagcccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccagttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattctgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 415763 - DNA, 6651 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccagttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattctgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 415764 - DNA, 6993 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccagttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattctgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaaaaaaaaaacacaacggacacaaacaaaagctgtggtggggccgctggcgacctcggaagaaagttctctagaaacccatgccgggtggggggaggcggggccgccgagcggtgtgcaggaacaccgcgccccaaggacgtgtgcccgagggaaacccgggtgcagacaaaagggggcggtgtctctcccccataaaaaaaagcggcgggcgacagcgggctttgcgaaacaccccgaagggtggcggggcaagacggggcccacaacagggctcacggaagcattatc

SEQ ID NO: 415765 - DNA, 6276 bp, Homo sapiens
cacacgcatcacagccatttgagaaatggcttctttgcagagctggggaagccgggcagaagatgccgcagcctcctactctgggtcctgagggggggtggcaggtaccacagtgtaggcagcagggtcagggcccctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccagttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattctgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 415766 - DNA, 6823 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgcgaaatatcttaaaacgcaaaaaccagttgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattctgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 415767 - DNA, 5557 bp, Homo sapiens
  misc_feature (5085)..(5085): n is a, c, g, or t
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagtcatgacaagaaataattggcttgtgagaatcaacattgaagctggaaaaatgatggcatccgaacaagtagacacagccctagtcaaggcaataaactacactaaagacagaggagaaagactcaaagttgttctaacatgtgagtacctaggggtgctgcatgccgttgtgtggtttgtgtactgcatagttgtactcagccaaggaagtggatgaggccacagctttaacatgggctgctgtctgcccagaaggataatcttttccttattttatatctcatttcaggggttctccaacttctgaaatccatccagaaactccctgtatttgggtaacagtattataactttttgcaccagggcttttttgtttgtttgttaatattaattgatttttcttatgttctttatgaaagaataactcatccattaatgaaaccaaatgtgaacttagtgccttctgtgtagaaaaggctaggaatacatattgtgggagattcattacatcactggccttaatactacaccttctcatgttcccccttggctgtgtaactttctagtgtccatatgctctctcttggggtggccagtgtgacttgctttggccaatgggatattagcaaccatgacataacccgaggcttataaagttgcctgctcattgggacttgtttcactgttgcatcccagttattcacatcactccagctgacagccaaccaacaaacagccagacacgtgagcccaaccaagatcagaagaactgtcccactgagcatagtctaaattgctaacatgcaaatgcatgaaacagaccacagcaaggtaatcttacagcccaggactcagctgctgcaatctctgtgaaaggttctgctcatgaaacagagacaaccatgtgtggtgcctgcattcttggcctgcggggagtggaaaggagacaaagagtaaaacacggtgggaaagaagaaaaagaggttaagaaaagcaaatgtgcctactccaggtaattttgacttagggaccctgattaacttacacactaattaaaccatttccagattttgtgcagtctgaaagcagcccattttccccaacaccaggtcgctcaagatgaccacaggaaggttgtcatcttcatgtctaaaagccagttgacactcaagggtgtcatttcacttcagtgaaatgagaagcttcacagatgtgtagactctgaaaaatctaactggaaaacaatacagggaaatagcaatactaggcatcaaagcagcaaaaaaactactcaattatctgatatggggattatcaatggaataaatgtggggtttgttgtttgttgttgggattgttgtgggttttgtttcattttttagggtctcacttttctccaccaattagatctgtgctgtgagccacacaggttttgagtacatgttttgggactttatatcggtcagactttgccatggtaacactgtgtaacgagcagccccaaaaatctcagtggtggtcaaaagcaaacctttatttntcattcatgggttttcagtttgttcaggctaaaagtaaaatacacagattcttcacctgtctttcattccatgctgaaggagcaattgactgcctgggacatacttttctcataacagaggcaagggtgaaaaacaccaagtcatcttgattatgcaatcccatttttaatgtaaacaatgtcatgtctgcttctatttcattgagcaaagcaagtcatataggcaagcccaacatcagtggggtgataaagcacactctccaatggaaggaggaggggagcatgatcatttgctgaacagtaatgcaagatagcacaagacttgtctggggtgagagagagatcaaagctgtggatcccacccagtcttcaaccaaagcaatgtggctttgacctgttttctgtcttggacttgaataatactttatttgaaagaagtgttaaattgtttattaaaaaaaagacaagtttg

SEQ ID NO: 415768 - DNA, 2781 bp, Homo sapiens
ttacaaatttcacttgataatttacatggaaatatgaaagggttctttctccaagtgtcttgcaattgacttggaatcagcgagttaaacaaaagggactgagcctctaactctgggaatttcaaggctccagttacagcaaatgacatgctgtcccctccacctatgtctatgcaggtctgccttgggaaccacctcacacatcagtgccttcgctgtccatctgtgtatgttattcaaattcacataagttaagataaagatccaggatgataaaaaccaatcctgataggtgggattagagaattacttctttctgtagttaataacacaaagcaatcctgttcaggttctttggataagcctccctactttccttcttctgttcttgttctcccttagcccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaaggtaccatgatgaattcctctgtgcttttcttccatgaggttgctccatgaccatctttttgcgtctggatttgaaggttgcccatgaagattgttggttccatgtcaaactaaagcatttcttgagggtttttcttcatggcttaaaaacgttgtgccttaaagctgtgattttattaataaaataataaatcatgactgttaaca

SEQ ID NO: 415769 - DNA, 3551 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagagggtggatttctgcatgatgaaattatgagactcacccgtaatacgctggaaaaactgatggccttacctcttacccatgtggtgcccatccaaagcaagatgctgtcataagttttagtagagacgggatttcaccatgttagccaggatggtctcgatctcctgacctcgggatccacccgcctcggcctcccaaagtgctgggattacaggcatgagccaccgcgcccggccggaactgcactcttcagatgactcagacaaggaaagcatgatccaacacctctaatagcccagtaatacatatgatatttgaaaggcccttcacttaccatgttaaccattcagttaaatcctccaaatcctaattctctgctgctcaaccatcagatccaaactttcaatgcccaggacggaaatcttttcaaccagcacatcaaatggcttttcctccttctatagaacttataaaaatgatcttttcagttaccattttactggtccatctgtattctattttcagtgcacttctgttcattttggaattaggaagcgtacaaattctttttatatttaattttaacattcaagttaggcatattttgaagaaaaagatattgcaatgattgcatttgtccactagagggcaggaacttacttctgtggttcattctgcactttttttttcactacccacctaagaaaaatctagtcaatgcgactgaagtactaccaccttctgaatcttctttccttgataattgcttaattggaatttaaatctttgaatcaaattaagaaactagacattcctagtttctgtttctatcacaatttccagtaccagatttttattcactcataaaaacaaataatgggggagaaataaaatattgacttctgctgattctcttgagtgggataaggaatttggtttttgcactttggcttacagatccatatagtggaattattcgatctttcaattataatatcagaaagttcaattttagtattgtactcct

SEQ ID NO: 415770 - DNA, 3658 bp, Homo sapiens
  misc_feature (3540)..(3540): n is a, c, g, or t
  misc_feature (3552)..(3552): n is a, c, g, or t
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactggtggagcaaaacaaaaaaaaaaaacaaaacaaaaaaaatgtgtgtgtgggcgcgcgcccgtgggcccccgcgagaaaactttttaaaacaaccaatcgtgggtgggggcggcgcgcgggccccggtgggggttaaggtgaacacgtgtgggtccaaagagggtgttcccagaggaaaaccgcgggccgaggacactaggtggggtgggtttctctcacaccaacatctaaaaaaaccgcgccccggggggcgcaacaccgagagcggggtctccgtgagacaacaaaatcaccaaagagggagagcgtcccagaggagggggccacataccaagcggggtactgcaccatactcaaaaaaggcgagtgcgctccaaaggcgagagcgtctcgaacattaatacaaatattaacccgccccggtccncagggggatganaagagcagaaacgccatcaacggactgagacaataaaacaccagagcaagaacaacaaatcgacacaagtaaacgaacagaacgaatcaagacaaacagaatgaga

SEQ ID NO: 415771 - DNA, 1780 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctgcttgctattgcttttttgttagatgctttggaataggaaaaatataacaattaaggtcctgtccccgacttcaacaaatatttcttgagctcttactatgtgcccataggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatttaacttatgaatctagctaagggaaagaaggaatagaaaattaaatgtatgaaccaattccccgtaaattgtaattttctaaacaactggattctgagcagtcaataaatacacattgagtaatctactatgtttattatatgttcaaactttcagaccaatgtcaattgcaggcaaatttaaaaggaaaatgagattcaaataacatgagttatgtttaaattagaaaaaattatctctaacaaattaaatgtaatgataattatctgaagttggagaaaactttaaaaaacctctatgctaaaactttgaaaaattattattcatagtaaagtataatttacttggatgacttatagaattagaatgctttttaaaaatctaaaaaccaaagactgtttcagagctaggaaataaatgtttctgtgaactgactatgatgtatcaaaactctgttttaaatctctgtgataatttcattcctacataacaatgactctagaaaatatccactaattagcaaaaaattttggccatattcacaagaggtattttaaacaagccacggaagaaaagggttatat

SEQ ID NO: 415772 - DNA, 1565 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggcattgagaatatggtggtgaagaaaatgaaactcaaggtttcaaggacaatagagtcttctggggaaactagccaataagcatgccaacaaatgcgtctgtaaactgggggaagtgctataaaaagaaagactggagaactactattgagaagaagggaagctcattccagaaaaagaaaacaatgctcgcaaatccctgaggctggaaataatttccctactggatttaagcaactgagaaaagaccaccgcattcaagcataaagagaaaacatgagagatggatttgcaaagacatgcaaagaatttttttccttttgcaatcacttctgattttaccttttctggataacctctggtaaaatataataatcaaaatatttaacttatgaatctagctaagggaaagaaggaatagaaaattaaatgtatgaaccaattccccgtaaattgtaattttctaaacaactggattctgagcagtcaataaatacacattgagtaatctactatgtttattatatgttcaaactttcagaccaatgtcaattgcaggcaaatttaaaaggaaaatgagattcaaataacatgagttatgtttaaattagaaaaaattatctctaacaaattaaatgtaatgataattatctgaagttggagaaaactttaaaaaacctctatgctaaaactttgaaaaattattattcatagtaaagtataatttacttggatgacttatagaattagaatgctttttaaaaatctaaaaaccaaagactgtttcagagctaggaaataaatgtttctgtgaactgactatgatgtatcaaaactctgttttaaatctctgtgataatttcattcctacataacaatgactctagaaaatatccactaattagcaaaaaattttggccatattcacaagaggtattttaaacaagccacggaagaaaagggttatat

SEQ ID NO: 415773 - DNA, 1024 bp, Homo sapiens
cacacgcatcacagccatttgagaaatggcttctttgcagagctggggaagccgggcagaagatgccgcagcctcctactctgggtcctgagggggggtggcaggtaccacagtgtaggcagcagggtcagggcccctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacaggtatgaattttctagttctttgttactttagccagtctcaccaaatttcaccaacctctactttctgttgttcggaagctgaagtgtgttttcttccatttcctgcgaagtgcctctgagaactctggggttccaccactaaagcctcccgcctcccataagcagtcatgtccacatgtgtatgaagcaatagcatcatttctccacagcctaagtttttaagtcttctaaaatgcaaccacggctgacattttcagatcaatgggatttttgtgtaactgaactcattcttcagtgtacttgaagccatgtccagtcctacccggttctctgggctgtgttcatctacatgacagctccgaagttcttaagtggtggctcatgcttgtaatcccagcactttgggacggcgaggcgggcggatcacctgaggtcaggagt

SEQ ID NO: 415774 - DNA, 401 bp, Homo sapiens
cttctggtatgttgaggcagaagaaaggcaaagaataactgctgcagctcttagactctttgttttcctgttattgaggagcctttctaagaaagcaccacggtcatccttgcttcatgggaatctggggtttgttttgttggtgttttatagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggtagagtatatgaatgttactaagagaggcagctggagacacctgattccttttggttaaagcctcctaaggtagaaagtcccagtggtc

SEQ ID NO: 415775 - DNA, 4198 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 415776 - DNA, 2430 bp, Homo sapiens
  misc_feature (2402)..(2402): n is a, c, g, or t
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaagaaattcccaacattcccattttgtgggctccagaaaggggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgaggtactattatatttgaccattgccctttcttttcttcatttttttccaaataagattcatgtaacattaatgcacagttttcctgaaaaagaaagattattaaccattattacagttatcatcattctttttttttcttatttctactcaataagaaaaaggctaagggttcagccttaacagtatacagngtaaaatccatgaaactgccttttcatt

SEQ ID NO: 415777 - DNA, 418 bp, Homo sapiens
  misc_feature (72)..(72): n is a, c, g, or t
ctcccggctttagctccttgcctctcttgcgcgcataacgcgaagaagaacaaaaaaaaactaaggttaccnagcggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctatt

SEQ ID NO: 415778 - DNA, 500 bp, Homo sapiens
agagttgctttttctttatgccattgatatttggctatgttagaatattatttaattctcagttatcatagtgaattaaaaatttatatgtatcagataatcaccatcagatttatctgccatttgcaatgaatttctgactacaatattaggagaatcgaaaaggaaccctttcctgtgtagttcattaaaaatctacataagaaaacactgtgtataagcattggtgtgcatagtggattatctttttatcttgttgcaatttcttttccctataagccttcaccacttttaaatatcagtctttttttaaattattattatactttaagttttagggtacatgtgcacaatgtgcaggttagttacatatgtatacatgtgacatgctggtgcattgcacccactaactcgtcatctagcttaggtatatctcccaatgctatcccgagctggttttttgaaaggatcaacaaaattgatagaccgctagcaagact

SEQ ID NO: 415779 - DNA, 459 bp, Homo sapiens
tgttcttcagaatagatgccacagtcattgcctttaccaatgcttgctgctttcaggaagtgggagtcagtgttaaatgctgctgttggtaaatcatactgttggactctgatgtggccattctgtgtgtcagtgcagaaaatgtcatccttgctaggcacagtggcactcgcctgtaatccctgctcctcaggaggctcaggcaggaggattgcatgaggccaagtgtttgagaccagcctgggcaacatagcaacaccctgcctctaaaaaaattaacaaaaagaaaatgtaaaaaaaaaatgaaaataaaatgtcatcctttcatatcaaagcattcagaagagcatcattttagaacaaacatttcccttatttccttggtcacttatggttggaggtgaaaatcttctcattttcagtacacaataagaaacacttccaaagcatctggtaaag

SEQ ID NO: 415780 - DNA, 321 bp, Homo sapiens
gagtagaaaagaccaaagcaggaaaagaaccagagcaaagaaaaaaaagttacatggaaaccaacatttgcggttttggagtttaacggtgtaagaaaaataatctttgcactacctgggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctatt

SEQ ID NO: 415781 - DNA, 4297 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 415782 - DNA, 2532 bp, Homo sapiens
acagccaattccagactccatcatttctcgttatgtcaggtgctcccacgagacacagcctcactcagcactactccttcagaatctgctcgtgctcaggctacatctcggcctctctacagcttcctgcgcaaaacaaaagtccagtccaggtgcagcagcaaggagaacattctcagagccaattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 415783 - DNA, 3180 bp, Homo sapiens
tgaataggctgatgaggaggcggaggaagaggaaaaggagttggttttgctgtctcaggagtggcagaggcagagaagagttgtcagggaggtagaagaggcaggcacactcaagtgtaacatttatggaaaaaagtctgcatgcatgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 415784 - DNA, 3757 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacatgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattatttaaaaa

SEQ ID NO: 415785 - DNA, 3299 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctatt

SEQ ID NO: 415786 - DNA, 3502 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaagggcacagtggcactcgcctgtaatccctgctcctcaggaggctcaggcaggaggattgcatgaggccaagtgtttgagaccagcctgggcaacatagcaacaccctgcctctaaaaaaattaacaaaaagaaaatgtaaaaaaaaaatgaaaataaaatgtcatcctttcatatcaaagcattcagaagagcatcattttagaacaaacatttcccttatttccttggtcacttatggttggaggtgaaaatcttctcattttcagtacacaataagaaacacttccaaagcatctggtaaag

SEQ ID NO: 415787 - DNA, 3225 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaagcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaagggtaatgctttctaatgaccagaaaccaaaatggaagcctggtaacagttagggatatgatttcctaactgtccaaaataaacatctagagttttctatt

SEQ ID NO: 415788 - DNA, 2562 bp, Homo sapiens
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagaagcatccattctacaccagtcctgctgttgtcatggcacacggtgaacagcccatccctggtctcatcaattattcccatcattcaacagatgaacggattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatgtacgtcatcaccaagtcttactgtgct

SEQ ID NO: 415789 - DNA, 768 bp, Homo sapiens
tgacagaatacggcagtaaaagtgacagtttcagcattattaaaatcatcaataagaggagcttagttatgggtaaaaaatctaacaatattttctctgtcaatagtcattcattatctacctcttttaaactaatacatggaaaatatatgcacaaaatggttgtttttcctccatggttgttggggtgaatactgggagttattggtagcattctgatggtaatggcagaaatctttcatacattttaaacactattgctggttttgagaatattttcttctcctaatttcaggttgggtgggactatatcagcatacaagatagtaccagatgaaatagaagaaatcaaggtatagtatggcatttttcacctctacaaacatttagcatcttggtgaggggtggggaagagttgctttttctttatgccattgatatttggctatgttagaatattatttaattctcagttatcatagtgaattaaaaatttatatgtatcagataatcaccatcagatttatctgccatttgcaatgaatttctgactacaatattaggagaatcgaaaaggaaccctttcctgtgtagttcattaaaaatctacataagaaaacactgtgtataagcattggtgtgcatagtggattatctttttatcttgttgcaatttcttttccctataagccttcaccacttttaaatatcagtctttttttaaattattattatactttaagttttagggtacatgtgcacaatgtg

SEQ ID NO: 415790 - DNA, 3141 bp, Homo sapiens
acgcacactagtcgcgcgcgcgcacgggcgcgcgggcgcgcgcgcgcacacacacacacacacacacacacacacacacacacacacgcccttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgtagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415791 - DNA, 2830 bp, Homo sapiens
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacattattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415792 - DNA, 2909 bp, Homo sapiens
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415793 - DNA, 2930 bp, Homo sapiens
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415794 - DNA, 2834 bp, Homo sapiens
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcaggttttcttcttgatccttcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415795 - DNA, 2813 bp, Homo sapiens
aggaggaggaggaagatcaggaggaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415796 - DNA, 2179 bp, Homo sapiens
gaccttcgttctaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415797 - DNA, 2188 bp, Homo sapiens
ccacattggattccataattgacaaagagctactgcactgtgtcaagtgcacagttataattgaattaatgatatgggcaagtgtgagacacacaaaattaacatttgaagaggcctggtttaattttgtcttttacatatttgtgtctccaattatactttaatgaaagagaatatactcgcttaatggatttctttcaacaagcttagctgagctcatcattagctgcacttgttgttggcaccttgcgatgttttctctaatgtatttttatttctttctactaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 415798 - DNA, 1793 bp, Homo sapiens
acgcacactagtcgcgcgcgcgcacgggcgcgcgggcgcgcgcgcgcacacacacacacacacacacacacacacacacacacacacgcccttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgtagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacagtaagtcaagatgaaagagaaaaaaaaaatagtttttgttgttttgctagcaagttatacggtctcatactgatttttttttaaactaaggtgcctattttcttattcttgaaatctgatgactaacagactagttaaagttttttttttcatcaactattaccatccaaagagcaccctctagaaagtagcaggtttttgttttaagaagctgggaatggactttatttaaaatgatctaagaccctaaacagcatatataagtaaatttgttatttatgctaaaagtatgagagcaacttcggatactgcaacagcaaccaagggaaatggctgtaaggagctcacaaatccataaacgttgctgattacactgttaacgaaagctgtctcctctaggaggcca

SEQ ID NO: 415799 - DNA, 1475 bp, Homo sapiens
acgcacactagtcgcgcgcgcgcacgggcgcgcgggcgcgcgcgcgcacacacacacacacacacacacacacacacacacacacacgcccttggctacatcggacccagatgactgcctcctcacttcctccctcccgattccgccgcggcccccaaagactctcggggtggccccttgtccgcaccgcttggagggagtgtgctctgagttaagctggtctcttctggtcctggaaaaaaatgagtattgacaaggttgctggatctgcgtagaaaagaaagtgccacttaataaaaaatttagcccggcagtggtaccgtctgcagagcttgctgcccttggacgttagcaggaagccttcggggtgctgtaatcggcgggcagaggagagggaggccgcggaattaaaaggaacaaaagctagagcgccatgccaaacgtccccggcaagacccagttaggcaggagccgggagtgatgggaaaatgaactagaatacgatgagctgccccattacggcgggatggacggagtaggggttcccgcttccatgtacggagaccctcacgcgccgcggccgatccccccggttcaccacctgaaccacgggccgccgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaagaatttttcagatttatccccattttccagatgaagtggcttggccttggagagggtcagttacttgactgtcacgatagaaagaggaagcagaagaatgaagacaaagccatttaaaattttcttgttctttaccttttgcataaaaggtattcagttcacaaatgatgtaaaatttaattaaggcaagtgactgtcctgagaaagtcattaaaaccctcatgtcatttctcta

SEQ ID NO: 415800 - DNA, 526 bp, Homo sapiens
ctttcttaatgtaggtttctaatgcatttttacataaatttttgtttgattcccccagaatttttcagatttatccccattttccagatgaagtggcttggccttggagagggtcagttacttgactgtcacgatagaaagaggaagcagaagaatgaagacaaagccatttaaaattttcttgttctttaccttttgcataaaaggtattcagttcacaaatgatgtaaaatttaattaaggcaagtgactgtcctgagaaagtcattaaaaccctcatgtcatttctctaatcaaaaggctgccacgcttctattatttctttattacaaccctttatttttatttcttcaagttaaactggagcctgagccatcataagcctcttgctagtgattttttaaatcagtgatttacactttgaaaaaccaattttttttatttttccaatttatattggttagatccatagggtcactttgattagaaaagagagccattagaaattaaattggcaattctaaag

SEQ ID NO: 415801 - DNA, 2635 bp, Homo sapiens
taatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagccaaacgaagtggctcccatgtggcaagcacccttctcagtttcgcagtggcttggctcgggatccttggcagttcccccagccccaccctgtctgctccttcccagttccttcccgggccccacacgctgctccagctgccaactttgctgcagagccactgccgcccttgagcctctcaccatgagtgagccaccagctctccacgttcccctcatagcagtgtcactcccaaccccaccatggcccagggacccgtggacaggttggggatggggtgtgtgcccactgtgctcatcacaggagcctcagttgagagtgagcggggtacagtaaggcagtgcttcccacactggacctctttcctggttctcttttgcaatacattaacagaccctttatcaacataaacaatagtaactgagctattaaaggcaacctctctga

SEQ ID NO: 415802 - DNA, 2413 bp, Homo sapiens
ccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagcctcagttgagagtgagcggggtacagtaaggcagtgcttcccacactggacctctttcctggttctcttttgcaatacattaacagaccctttatcaacataaacaatagtaactgagctattaaaggcaacctctctga

SEQ ID NO: 415803 - DNA, 1843 bp, Homo sapiens
ccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagcctcagttgagagtgagcggggtacagtaaggcagtgcttcccacactggacctctttcctggttctcttttgcaatacattaacagaccctttatcaacataaacaatagtaactgagctattaaaggcaacctctctga

SEQ ID NO: 415804 - DNA, 1667 bp, Homo sapiens
ccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgtttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctggaaaaagaaatgggaacttatttgggcacctttgatgattacttggagttattcctgcagtttggttatgtgagccttttctcctgtgtttacccattagcagctgcctttgctgtgttaaataacttcactgaagtaaattcagatgccttaaaaatgtgcagggtcttcaaacgtccattctcagaaccttcagccaatattggtgtgtggcagttggcttttgaaacgatgagtgttatatctgtggtcactaactgtgcgctgattggaatgtcaccacaagtgaatgcagtctttccagaatcaaaagcagacctcattttgattgtagtagcagtggagcacgcactcctggctttaaagtttatacttgcatttgccatacctgataagccacggcatatccagatgaaactagccagactggaatttgagtctttggaggcactcaagcagcagcaaatgaagctcgtgaccgagaacctgaaggaggaaccaatggaaagcgggaaggagaaggcaacctgagtgcccagcgtgcccagctgccctgttggcagaggcctgtgtctgtgccacacctgccacggtggcagggggggtacccggggcagcatcgtggctcctgaacccagacccaatgcttagcctcagttgagagtgagcggggtacagtaaggcagtgcttcccacactggacctctttcctggttctcttttgcaatacattaacagaccctttatcaacataaacaatagtaactgagctattaaaggcaacctctctga

SEQ ID NO: 415805 - DNA, 1728 bp, Homo sapiens
  misc_feature (1688)..(1688): n is a, c, g, or t
  misc_feature (1714)..(1714): n is a, c, g, or t
ccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttgggtatcaattccatcactgggaaggaggagcctctgtaccccagctacaagagacagttgcgcatttacctggtctccctgccattcgtgtgcctctgcctctatttctcactgtatgtcatgatgatttacttcgacatggaggtttgggccttgggtctacatgagaacagcgggtctgagtggaccagtgtcctgttgtatgtgcccagcatcatctatgccattgtgattgagatcatgaatcgtctctatcgatatgctgccgagtttttaacttcatgggagaatcacagattggaatctgcctatcagaaccatctaattctgaaagttttagtgttcaacttcctcaattgctttgcctcactcttctatattgcctttgtcttgaaagatatgaagcttttgcgccagagcttggccactctcctaattacctcccagatcctcaaccaaattatggaatcttttcttccttattggctccaaaggaagcatggtgtgcgggtgaagaggaaggtgcaggctttaaaggcagacattgatgctacattatatgaacaagtcatcctgtgcagagaacatctgaaagactaaagaagactgtatgaagagcaaggcaccgaaaggagaccgcatntgatatgtcaggagagggtctacctnaatttgccagtcct

SEQ ID NO: 415806 - DNA, 1137 bp, Homo sapiens
ccgcatctaggccccgccgcgtccgccacgcccagcgctcggcggcgcccgccccactggcctggcccgccccccgcaccgagcactctttcgcccggcctccggttctcgccggctctcggacccgcctccgaagacgtggagcgctgcggcggctgatttgtcaaagatgaaagtgaccttatcagctttggatacttctgagagttctttcacacctttggtggtcatagaacttgctcaggatgtcaaagaagaaaccaaagaatggctgaaaaacagaattatagctaaaaaaaaagatggaggtgcccagttgttgtttagaccattgttaaataaatatgaacaagaaacactagaaaatcagaacttatatcttgttggtgcctccaagattagaatgttactaggggcagaagcagtgggattggtaaaagagtgcaatgataacaccatgagagccttcacatacagaaccagacagaacttcaaaggttttgatgataacaatgatgatttcctgacaatggcagaatgtcaattcattatcaaacatgaacttgaaaatcttagagctaaagatgaaaaaatgatccctggttaccctcaggcaaagttgtatccaggaaaatcattgttgagaagattgctcacgtctggcatcgtgattcaggtgtttccactgcatgacagtgaagccctgaagaagcttgaggacacctggtacactcggtttgctttgaagtatcagcccatagacagtattcgtggctactttggggaaacaattgctctgtactttggatttttggagtatttcacttttgcattaatccccatggctgtcattgggttaccttactacttgtttgtgtgggaagactatgacaagtacgtgatctttgcctcgttcaacctcatctggtccacggtgattctggaactgtggaagcgtggctgtgccaacatgacctacaggtgggggacactgctcatgaagagaaagtttgaggagccccggccaggatttcatggtgtcttggacctctttcctggttctcttttgcaatacattaacagaccctttatcaacataaacaatagtaactgagctattaaaggcaacctctctga

SEQ ID NO: 415807 - DNA, 327 bp, Homo sapiens
taattctgaaagttttagtggtaagtacagcgtttatgtacaaatccattttatgaaactggtatatactacataatatataggaatacaaatatgaagagttgcttctaatctaagatatcaatatattttgtgcaaataggcaaggattgattaataaatatgtgtacctctgtgttcagtagccttattacaaatgtgcatgtgatgtaagacttcaaaatataggagttagtattatagccaatttccagttatttaaaaactaggccaggtgtggtggttcatacctgtaatctcagcactttggaaggcctatgctggtgg

SEQ ID NO: 415808 - DNA, 422 bp, Homo sapiens
ggttgaagcctccttgtccacctgcttgccctgggactatgggtcagttgcttcccctcgctgaggctcagtttctttatctgggaaatgagggtaacaagtgtgcacccggtggggctggggtggggactgggtacggtcatctccataaagcatttagttcaaggcctggcctggaggcagcactcaacagctgcagggacggacttccaggactcaattttctcatctgtgccatgctctgtgcatgtcgttggggagacagttccatcttatcccgccagtgtgtctcctcagtctcttagaagccaccctaggcaggggcaggggcaggggccggggaggtgaggtctggcttcttattctgcctgggaggccagggctgtgcttgtggactttgtccctgagttgtgccaagtcct

SEQ ID NO: 415809 - DNA, 1015 bp, Homo sapiens
gccatccgtgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtggggggccttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccaggccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcactgcccggggtggagagctgtcaaaactatttattccgctatgggcgccacccccttatggagctgccactcatgatcaaccccactggctgtgcccgatcagagcctaaaatcctcacacactacaaacggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataa

SEQ ID NO: 415810 - DNA, 746 bp, Homo sapiens
  misc_feature (204)..(204): n is a, c, g, or t
cccacgcgtccggttgtcacggatccggagggaaaggcggtgccagccctaagtggcaagcgggtgcaccaatgggggtgggaggcttagccccgcctcgggagctcgggttccggcgggttgcatcagctgggtggggcaccgcctggcagcccggactcccccgacatgtgatcggcttcccagggagggcgggaggccggncgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcatagtggatttgtccacaagggggtgccagctgtgttgtatgtattgttagcggaaggggtgataaatgcgttcatgctcttgctaggcctaattcgttttcctttgtgctgcagaagttgcctgcgacctatgagggatcctctagatcga

SEQ ID NO: 415811 - DNA, 898 bp, Homo sapiens
  misc_feature (688)..(688): n is a, c, g, or t
  misc_feature (706)..(706): n is a, c, g, or t
  misc_feature (716)..(717): n is a, c, g, or t
  misc_feature (721)..(721): n is a, c, g, or t
  misc_feature (731)..(731): n is a, c, g, or t
  misc_feature (775)..(775): n is a, c, g, or t
  misc_feature (791)..(791): n is a, c, g, or t
  misc_feature (795)..(795): n is a, c, g, or t
  misc_feature (805)..(805): n is a, c, g, or t
  misc_feature (810)..(810): n is a, c, g, or t
cactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggtttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcanttaaacagaggtcaagcnataggcgccnngcantgtcaagccngaaaccaagcataccgtcatgtttcaccaagcccagagccctangatacaaacaactatngccngaacctcctnagctntccctctgcagagttccctaccctaagagaatgttaccacctgaacagtcctcggtgaatctgagaggagaggatggggtaaggcaga

SEQ ID NO: 415812 - DNA, 844 bp, Homo sapiens
  misc_feature (601)..(601): n is a, c, g, or t
  misc_feature (634)..(634): n is a, c, g, or t
  misc_feature (652)..(652): n is a, c, g, or t
  misc_feature (662)..(663): n is a, c, g, or t
  misc_feature (667)..(667): n is a, c, g, or t
  misc_feature (677)..(677): n is a, c, g, or t
  misc_feature (721)..(721): n is a, c, g, or t
  misc_feature (737)..(737): n is a, c, g, or t
  misc_feature (741)..(741): n is a, c, g, or t
  misc_feature (751)..(751): n is a, c, g, or t
  misc_feature (756)..(756): n is a, c, g, or t
cactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggtttttaagtgcttgtggctcactgaagcttaagtgaggatttccttgcaatgagtagaatttcccttctctcccttgtcacaggtttatagtgtaactccttcatgcaataaactgaanagagccatgctgtctagtcttgaagtccctcanttaaacagaggtcaagcnataggcgccnngcantgtcaagccngaaaccaagcataccgtcatgtttcaccaagcccagagccctangatacaaacaactatngccngaacctcctnagctntccctctgcagagttccctaccctaagagaatgttaccacctgaacagtcctcggtgaatctgagaggagaggatggggtaaggcaga

SEQ ID NO: 415813 - DNA, 427 bp, Homo sapiens
cactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtattcagctacggtgatgagtatcttctggtccccag

SEQ ID NO: 415814 - DNA, 421 bp, Homo sapiens
cactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagctgtgcgacggagactgtgcaggcggccgct

SEQ ID NO: 415815 - DNA, 846 bp, Homo sapiens
  misc_feature (636)..(636): n is a, c, g, or t
  misc_feature (654)..(654): n is a, c, g, or t
  misc_feature (664)..(665): n is a, c, g, or t
  misc_feature (669)..(669): n is a, c, g, or t
  misc_feature (679)..(679): n is a, c, g, or t
  misc_feature (723)..(723): n is a, c, g, or t
  misc_feature (739)..(739): n is a, c, g, or t
  misc_feature (743)..(743): n is a, c, g, or t
  misc_feature (753)..(753): n is a, c, g, or t
  misc_feature (758)..(758): n is a, c, g, or t
cactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagtaattcagctacagggtgaccaacgcaagaacatatgccagttcctcgtagagattggactggctaaggacgatcagctgaaggttcatgggtttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcanttaaacagaggtcaagcnataggcgccnngcantgtcaagccngaaaccaagcataccgtcatgtttcaccaagcccagagccctangatacaaacaactatngccngaacctcctnagctntccctctgcagagttccctaccctaagagaatgttaccacctgaacagtcctcggtgaatctgagaggagaggatggggtaaggcaga

SEQ ID NO: 415816 - DNA, 832 bp, Homo sapiens
  misc_feature (622)..(622): n is a, c, g, or t
  misc_feature (640)..(640): n is a, c, g, or t
  misc_feature (650)..(651): n is a, c, g, or t
  misc_feature (655)..(655): n is a, c, g, or t
  misc_feature (665)..(665): n is a, c, g, or t
  misc_feature (709)..(709): n is a, c, g, or t
  misc_feature (725)..(725): n is a, c, g, or t
  misc_feature (729)..(729): n is a, c, g, or t
  misc_feature (739)..(739): n is a, c, g, or t
  misc_feature (744)..(744): n is a, c, g, or t
cgcgtctgcgggagccactctgcgacctcactgcttccaaactcgtactcgccccgggtggggccgagccctgtcctcgctggtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggtttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcanttaaacagaggtcaagcnataggcgccnngcantgtcaagccngaaaccaagcataccgtcatgtttcaccaagcccagagccctangatacaaacaactatngccngaacctcctnagctntccctctgcagagttccctaccctaagagaatgttaccacctgaacagtcctcggtgaatctgagaggagaggatggggtaaggcaga

SEQ ID NO: 415817 - DNA, 1121 bp, Homo sapiens
  misc_feature (204)..(204): n is a, c, g, or t
  misc_feature (911)..(911): n is a, c, g, or t
  misc_feature (929)..(929): n is a, c, g, or t
  misc_feature (939)..(940): n is a, c, g, or t
  misc_feature (944)..(944): n is a, c, g, or t
  misc_feature (954)..(954): n is a, c, g, or t
  misc_feature (998)..(998): n is a, c, g, or t
  misc_feature (1014)..(1014): n is a, c, g, or t
  misc_feature (1018)..(1018): n is a, c, g, or t
  misc_feature (1028)..(1028): n is a, c, g, or t
  misc_feature (1033)..(1033): n is a, c, g, or t
cccacgcgtccggttgtcacggatccggagggaaaggcggtgccagccctaagtggcaagcgggtgcaccaatgggggtgggaggcttagccccgcctcgggagctcgggttccggcgggttgcatcagctgggtggggcaccgcctggcagcccggactcccccgacatgtgatcggcttcccagggagggcgggaggccggncgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggtttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcanttaaacagaggtcaagcnataggcgccnngcantgtcaagccngaaaccaagcataccgtcatgtttcaccaagcccagagccctangatacaaacaactatngccngaacctcctnagctntccctctgcagagttccctaccctaagagaatgttaccacctgaacagtcctcggtgaatctgagaggagaggatggggtaaggcaga

SEQ ID NO: 415818 - DNA, 310 bp, Homo sapiens
gttttgccatattggccagactggtctcaaactcctgacctcaggcgatctgcctgcctcagcctcacaaagtgctgggattataggcgtcagccacagtgcctggcccataggggggtcttatgtgggtgagggaggggggctcctgttgagcagtgagtggatgagtcagggcagctctttcctctagccatcagcaacctctgccagacctttgcacggaggcttgggggaaacccatcaaggccacagtcctggacaggacctgggagagtgggtaagagagggtgcaaggacaggtgcctgaggc

SEQ ID NO: 415819 - DNA, 2415 bp, Homo sapiens
aaaaaaaaaaaaaaaaaaaaaaaaaaaaaaaaaagaattgactcgcgccctcgtccgccgccataggccagtgccggggtttaagggccaggaaaggaagcattcagggaatttaggtgtagccagaagaaaatcaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggaatcactgaccctggaggatgtggctgtggacttcacctgggaggagtggcagttcctgagccctgctcagaaggacctgtaccgggatgtgatgttggagaactacagcaaccttgtgtcagtggggtatcaagccggcaaacctgatgccctcaccaagttggaacaaggagaaccactatggacactagaagatgaaatccacagtccagcccacccagaaattgagaaagctgatgatcatctgcagcagcccttgcaaaaccaaaaaatactgaagaggacgggacaacgctatgaacacggaagaactttgaaatcatatttaggtttaaccaaccagagcagaagatacaacagaaaggagcctgctgagtttaatggagatggagcttttctccatgataatcatgaacaaatgcctacggaaattgaattccctgaaagtagaaaacccatcagcaccaagtcacaattccttaaacatcagcaaacacacaacatagagaaagcccatgaatgcactgactgtgggaaagctttcctcaagaagtctcagctcactgagcataagagaattcatacaggaaagaaaccccacgtgtgtagcttgtgtgggaaagccttctacaagaagtacaggctcactgaacacgagagagctcacagaggagagaaaccccacgggtgtagcttgtgtgggaaagccttctacaagaggtacaggctcactgaacacgagagagctcacaaaggagagaaaccatacgggtgcagtgaatgtgggaaagccttccccaggaaatctgagcttactgaacatcaaaggattcacacgggaattaagccccatcaatgcagcgaatgtgggagagctttctccagaaaatcactactcgttgtacatcagcgaactcatacaggagagaagcctcatacatgcagtgaatgtggaaaaggcttcattcagaagggcaatctcaacatacatcaacgaactcacactggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttgatcatatagcctccagcggaatgctgagtttgtcatgtcccatgggcctttggctccctgcactaatatgtatagtagggtttacaagatatgaaatatattttacttttttatatcttataaacctcactacccctcccacaatattgtttttcatttactatcttgatcatagagtttggctggggaggggggcagttttagaggcttccacttggtgttcctcagaatgatatctcttactccgggggccaaggtaggggttagcttttgttctctttgtagtttagattgtatctcttgccttgttcaagttcacaaatctttttgtgtatacacatatgtacatgaaaatgatgttcatgctttttattattttacccttcattatttcattttttatagttctcatagctatgtctttcagttcactaatcttttttccacagtgtttaatctgtcattaatcccatccaaagtatgttttctctcagaaattgtaatttttaacctctaataatttgacatgggtttttccctgttatatctttcata

SEQ ID NO: 415820 - DNA, 1861 bp, Homo sapiens
aaaaaaaaaaaaaaaaaaaaaaaaaaaaaaaaaagaattgactcgcgccctcgtccgccgccataggccagtgccggggtttaagggccaggaaaggaagcattcagggaatttaggtgtagccagaagaaaatcaggtcctggctccccagaagcaagagagttcaaatgaaggaaggaggaggttcctggatgtggatgtcatcatttctgggaacactcttaaatggagactcagatttcttagccaaaatttagggaggatccagaagaaaccaaagacgaagcatcccagttcttgggtatttcctgaaacagaagaaaatgacaaaggcccaggaatcactgaccctggaggatgtggctgtggacttcacctgggaggagtggcagttcctgagccctgctcagaaggacctgtaccgggatgtgatgttggagaactacagcaaccttgtgtcagtggggtatcaagccggcaaacctgatgccctcaccaagttggaacaaggagaaccactatggacactagaagatgaaatccacagtccagcccacccagaaattgagaaagctgatgatcatctgcagcagcccttgcaaaaccaaaaaatactgaagaggacgggacaacgctatgaacacggaagaactttgaaatcatatttaggtttaaccaaccagagcagaagatacaacagaaaggagcctgctgagtttaatggagatggagcttttctccatgataatcatgaacaaatgcctacggaaattgaattccctgaaagtagaaaacccatcagcaccaagtcacaattccttaaacatcagcaaacacacaacatagagaaagcccatgaatgcactgactgtgggaaagctttcctcaagaagtctcagctcactgagcataagagaattcatacaggaaagaaaccccacgtgtgtagcttgtgtgggaaagccttctacaagaagtacaggctcactgaacacgagagagctcacagaggagagaaaccccacgggtgtagcttgtgtgggaaagccttctacaagaggtacaggctcactgaacacgagagagctcacaaaggagagaaaccatacgggtgcagtgaatgtgggaaagccttccccaggaaatctgagcttactgaacatcaaaggattcacacgggaattaagccccatcaatgcagcgaatgtgggagagctttctccagaaaatcactactcgttgtacatcagcgaactcatacaggagagaagcctcatacatgcagtgaatgtggaaaaggcttcattcagaagggcaatctcaacatacatcaacgaactcacactggagagaaaccttatggatgcattgactgtggcaaggccttcagccagaagtcttgccttgtagcacatcagagatatcatacaggaaagactccctttgtatgtcctgaatgtgggcaaccctgttcacagaagtcaggactcattagacatcagaaaattcactcaggagagaaaccctataaatgcagtgactgtgggaaagccttccttacaaagacaatgctcattgtacatcacagaactcacacgggagagagaccctatggctgtgatgagtgtgagaaagcttacttctatatgtcttgccttgttaaacataagagaatacactcaagggagaaacggggggattcagtgaaggtggaaaatccttccacagcaagtcacagcttaagtcctagtgaacatgtgcaggggaaaagccctgttaatatggtaactgtggcaatggtggcagggcagtgtgagtttgcccacatcctgcattcatgataaacagtttgctgtttga

SEQ ID NO: 415821 - DNA, 452 bp, Homo sapiens
gtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgtgagtaactagtggtaaagcttaggccttcttttttagaaaacttaatcaaggctcaactgcccattacccgagaaactccctaaaaactaggaaacttctttttaggagtggaaattagaggccctaaaagcacctcgtttaccccaaatagatttatttactgataggcttttgtctgtgtttcctttgaaacacaatttatgtgtcagactgtgtttcctttgaaacacaatttatcaaagtatgatacttgcatacattcttttcaaatggtaaagaacagtgcagacaaaataaaacctgactacgttccag

SEQ ID NO: 415822 - DNA, 445 bp, Homo sapiens
gaaagacctcatgctcttacacattacaagcggttgtgagaatcaaatgagatagggtgcatctcagaatctgaaaaatactgtgcacacggaaagtattatttggtctctaaggcccatcaacttggtcctaactcacttttatcagtttgtagaacttaatctttttaagttctccgtatttttttatgctttcattttttaatgtgctaccctctctacctgggatgtgctttttctacagggcaagctctgcatttcccctcctctcctttttctcatcgtggtttgtacttgcctctcagcacccatcacactggatgtaactacaggcatgtctctcctgtttgactgtaaactccttgctggacacatatctcaggagtccttacagccatttcaatgctgttgcaaagtggatatttaataaatatttgttgaagga

SEQ ID NO: 415823 - DNA, 1455 bp, Homo sapiens
gtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccaga

SEQ ID NO: 415824 - DNA, 1249 bp, Homo sapiens
tcccctgggctgcaggaattcggcacgagagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccaga

SEQ ID NO: 415825 - DNA, 1033 bp, Homo sapiens
ataccagtttgacggagactctctcataatgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccaga

SEQ ID NO: 415826 - DNA, 821 bp, Homo sapiens
  misc_feature (22)..(22): n is a, c, g, or t
tctacaggatcccattactcanctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccaga

SEQ ID NO: 415827 - DNA, 1597 bp, Homo sapiens
gtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaaggtctgctctctaccaatctaggagaatattctgttgaaattgcaggaattaccagttacgtccaacaagccagagttctgagagtaagacccccagggaaggcttaccagttgcagagtgcacacagcgaataggctggttctccatgaggattgtattttttggcttctggtcttctccatgactagtggtctggataggagttttgtgtccagaaaattttatgtaatttatttttttaaagaacctgttgtacatctttctcaaatacaaacttgggctttagctgccccctccactaaaccgatgacttacttttttgactagaatgagaaaatggcaagaatcttagtaaggtggtagccagcttggtaactgcatagtaatcgagaggctgtaagatgggaattcatcgtaggcagcgaggtagagtgggtcccctgaaatgggattcgcttggcactgcctcttaaagataggggtgttgggatcttgattgtggccgccccccccagctttacctgcccactttgtccttcttggcaagcctgttcacatggacgtccagagccagtggacagagaggaggggacggacagcagaggtgctgcttttgcagcagaaactttgttgcagttcagagtataccttctgctctgctccagagcaagagttgcaaaccaggcccttggggctggccatttgtttttgtaaataaagttttattggaacacagcccagaccaatttgtgtttgtattatctgtggctgctttcagattcgaaggcagaattgagtagttgacatagagactggatggccctgaagcctaaagtatttcctatatggccttttaagtaaaagcgttttttgtttgtttgttt

SEQ ID NO: 415828 - DNA, 914 bp, Homo sapiens
gtatgaatgctgctgtgtccaagactgtagctgtggcttctggggctgcaagcacccccatcagcatcagcacaggagcccccaccgtgcggcaggtccctgtcagcaccacggttgtgtccacgtcccaggctgggaagttgcctacacggatcacagttcccctctctgtgatcagccagccaatgaagggcaagagcgtggtcacagcccccatcatcaaaggcaaccttggagccaacctcagtgggttgggccgcaacatcatcctcacaactatgccagcaggcactaagctcattgctggcaataagcctgttagtttcctcactgctcagcagttgcagcagcttcagcagcaaggtcaggccacacaggtgcgcatccagactgtccctgcatcccatctccaacagggaacagcttctggctcctccaaagcagtctccactgttgttgtgactacagctccgtctcctaaacaggcacctgagcaacaatgattatgagagaggatggcttccgtgaaagaccatgcctggtctgtcctggctgagaagggaccagggaggttgcatcattgttttaagcttgcctgttcaaggcagccaggcgaggggtgatggcaacggtggcctggattcgtggcctggattctgctgccacgtgccatagtggagcaccctgagaaaggttcactccagggttccaagggcaagctctgcatttcccctcctctcctttttctcatcgtggtttgtacttgcctctcagcacccatcacactggatgtaactacaggcatgtctctcctgtttgactgtaaactccttgctggacacatatctcaggagtccttacagccatttcaatgctgttgcaaagtggatatttaataaatatttgttgaagga

SEQ ID NO: 415829 - DNA, 854 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 415830 - DNA, 527 bp, Homo sapiens
taaaatggttttttgtttgtttgtatttttgagagacagggtcttactctgttacccaggctggagtgcagtagtaccatcgtggctcactgcagccttgacttccctggctcaagtgagcctcccatctcagcctcctgagtagctgggactacaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 415831 - DNA, 833 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtaagttctaaaaatctggcagtaatatttgtatttgaatttactttgcattaaatctgaagtgttctctagttacatgctttaaaaaattctcattttaaggttagtcatgaaagaagatggtgccaacttgtatgttgcaaaggtttcacaagttcctcgaatgaatccaagacctgtcatggtgaggtagactgactgtgaacttggctccaggcttatctatgtcattttcaaacactttcattttaagcaaaccatacaatatctttaagtcttgttccttaccttcaacaacaaaattaaattgcacttgtcctcctgatttcacggggttgatgtgaggaac

SEQ ID NO: 415832 - DNA, 395 bp, Homo sapiens
cactcatagaaactggaggcaaaatgcatgacagtaacaatgtggagaaagacattacaccatctgaattgcctgcaaacccagcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagaggtaggtttagacatctgcttttacattgatttttttttttttttttttttt

SEQ ID NO: 415833 - DNA, 2771 bp, Homo sapiens
gatcttggtggtagtagcaaatattcaaacgagaactttgaaggctgatgggagaagaggcgcatcttgctcccatcagccagctaaggctttggatgtacttgaaagaatattatgcttacagatatgaaataggtttgattcaggactttgcagtattcctatagttgatttataacatctcctgctaagcaaagcccactgactaattagtcaccactacacaaggaaaaacagcattatttttagaggctgaattaatgttagttttctcattttctcatcttcattctctctgctgttgaagaaatgttcagtggccaactgattctgcttcttctcttgcaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415834 - DNA, 2907 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415835 - DNA, 2803 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415836 - DNA, 2989 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415837 - DNA, 3068 bp, Homo sapiens
accgatgaatgggattagtgcccttacaaaaggggcccaccaaagctgccttgttccttctactatgtgaggacacatctagaagttaccatcaatgaaccagaaagtgggcccttaccaggcaccaaatctgccagcactctgatcttggacttccagcctcctgaactgttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagagaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415838 - DNA, 2717 bp, Homo sapiens
gatcttggtggtagtagcaaatattcaaacgagaactttgaaggctgatgggagaagaggcgcatcttgctcccatcagccagctaaggctttggatgtacttgaaagaatattatgcttacagatatgaaataggtttgattcaggactttgcagtattcctatagttgatttataacatctcctgctaagcaaagcccactgactaattagtcaccactacacaaggaaaaacagcattatttttagaggctgaattaatgttagttttctcattttctcatcttcattctctctgctgttgaagaaatgttcagtggccaactgattctgcttcttctcttgcaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattagaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415839 - DNA, 3091 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagtaagttctaaaaatctggcagtaatatttgtatttgaatttactttgcattaaatctgaagtgttctctagttacatgctttaaaaaattctcattttaaggttagtcatgaaagaagatggtgccaacttgtatgttgcaaaggtttcacaagttcctcgaatgaatccaagacctgtcatggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415840 - DNA, 2621 bp, Homo sapiens
tatgagtagttaagaatatagcatagcagcaacatttctgggagaggatgggttatgttagattaatgaatatcatctctgtgttttctgaaagaatttcctgttgagatataaaggcccatctgatcactggattgggctgagcagagaacaaggccaaccatggaaatggataaatggtactgaatggacaagacagtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415841 - DNA, 2580 bp, Homo sapiens
taaaatggttttttgtttgtttgtatttttgagagacagggtcttactctgttacccaggctggagtgcagtagtaccatcgtggctcactgcagccttgacttccctggctcaagtgagcctcccatctcagcctcctgagtagctgggactacaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattgactcatagttccacatggctggggaggtcttgcaatcatgacagaaggcaaatgggaagcaaagtcatgtcttatgtggtggcaggcagggggacttgtgcacaggaactcctatttatacaaccatcagatatcttgagacaagaacagtatggggctccctggtgtgattccgtcctgcgcggctgttctctggagcagcattcatttatcttcgtctgccttgtctcctacctaagtgtgtgtcgccacccgatggaagattcgatggacatggacatgagccccctgaggccccagaactatcttttcagttgtgaactaaaggccgacaaagatgatcactttaaggtggataatgatgaaaatgagaccagttatctttaagaacggtcagctcaggggctggtgcaaaggatgaactgcacattgttgaagcagaggccatgaatgacgaaggcagtccaattaaagtaacactggcaactttgaaaatgtctgtacagccaacggtttctcttgggggctttgaaataacaccaccagtggacttaaggttgaagtgtggttcagggccagtgcatattagtggacagcacttagtagctgtgaaggaaggtgcagagtcagaagatgaagaagaggaggatgtgaaactcttaagtatatctggaaagcagtctgcccctggaggtgggcagaaaaaagtaaaacttgctgctgctgctgatgatgatgatgatgaagatgatgatgatgatgatgacgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaaaaaacaggaaaaatctcctaaaacaccaaaaggatctagttctgtagaagacattaaagcaaaaatgcaagcaagtatagaaaaacgtggttctcttcccaaagtggaaaccaagttcatcaattatgtgaagaatttcttctggatgactgaccaagaggctattcaagatctctggcagtggaggaagtctctttaagaaaatagtttaaacaatttgttaaaaattttccatcttatttcatttctgtaacagttgatatctggctgtcctttttatagtgcagagtgagaactttccctaccatgtttgataaatgttgtccaggttctattgccaagaatgtgttgtccaaaatgcctgtttagtttttaaagatggaactccaccctttgcttggttttaagtatgtatgggatgctatgataggacatagtagtagcagtggtcagacatggaaatggtggggagacaaaagtatacacgtgaaataaaactcagtattttaataaagtaaaaaaaaaaaaaaggtatggggaaaactgcccccataaagcaattgtctccacctggccctgccctttgcatgtggagattattacaattcaaggtgaaatttgggtggagacacaaccaaaccatattagatggctatatcaaaaagacaagaaataacaagcattggtgagagtgtggagaagacggaacccttgtacacagttggtgggaacacagtttggtgcagccattatagaaaacgtcatggaggttcctaaagaaattaaaaagagaactaccatatgagccagcaatcccttttccagatatacacccaaaggaaatgaaatcaccacctcataaagatatctgctttcctgtttattataacacatctttattcataatagccaagatacggaactaactgaagtgaccattaacagatgaatggataaagaaattgtcatatatataaaacacacacattatatacatacatacatatatatatatataaaaaatagaatattattcagccttgtaaaaagaaatcctgttatgttgggaacaagccccccaaaatctggccataaactcaccccaaaactggccataaacaaaatctctgcagcactgtgacatgttagt

SEQ ID NO: 415842 - DNA, 936 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactgaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 415843 - DNA, 718 bp, Homo sapiens
gatcttggtggtagtagcaaatattcaaacgagaactttgaaggctgatgggagaagaggcgcatcttgctcccatcagccagctaaggctttggatgtacttgaaagaatattatgcttacagatatgaaataggtttgattcaggactttgcagtattcctatagttgatttataacatctcctgctaagcaaagcccactgactaattagtcaccactacacaaggaaaaacagcattatttttagaggctgaattaatgttagttttctcattttctcatcttcattctctctgctgttgaagaaatgttcagtggccaactgattctgcttcttctcttgcaggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 415844 - DNA, 750 bp, Homo sapiens
cactcatagaaactggaggcaaaatgcatgacagtaacaatgtggagaaagacattacaccatctgaattgcctgcaaacccaggttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtttcctatcctgggagcaggagagtgtgcctatttgaatgacaaaggtgccagtagtgccaggcactacacagagaggaagtggatttgttccaaatcagatatacatgtctagatgttacagcaaagccccaactaatctttagaagcatattggaactgataactccattttaaaatgagcaaagaatttatttcttataccaacaggtatatgaaaatatgctcaatatcactaataactgggaaaatacaaatcaaaatcatagtaaaatattacctgttttcatggtgctaatattacctgttctcccactgctaatgacatacccgagactgagtaatttataaataaaagagatttaattga

SEQ ID NO: 415845 - DNA, 892 bp, Homo sapiens
accgatgaatgggattagtgcccttacaaaaggggcccaccaaagctgccttgttccttctactatgtgaggacacatctagaagttaccatcaatgaaccagaaagtgggcccttaccaggcaccaaatctgccagcactctgatcttggacttccagcctcctgaactgttgtctgcattcaaaagagcattctattaaagctaccttaatttggcgcttatttttcttaatcatgtttctgacaatcatagtgtgtggaatggttgctgctttaagcgcaataagagctaactgccatcaagagccatcagtatgtcttcaagctgcatgcccagaaagctggattggttttcaaagaaagtgtttctatttttctgatgacaccaagaactggacatcaagtcagaggttttgtgactcacaagatgctgatcttgctcaggttgaaagcttccaggaactggtaagaaaatagttctggccagaatcaaagattcagccctacaaggatatgttttcctgtgaaattatctaagagaatttcctgttgagatataaaggcccatctgatcactggattgggctgagcagagaacaaggccaaccatggaaatggataaatggtactgaatggacaagacagttagtcatgaaagaagatggtgccaacttgtatgttgcaaaggtttcacaagttcctcgaatgaatccaagacctgtcatggtgaggtagactgactgtgaacttggctccaggcttatctatgtcattttcaaacactttcattttaagcaaaccatacaatatctttaagtcttgttccttaccttcaacaacaaaattaaattgcacttgtcctcctgatttcacggggttgatgtgaggaac

SEQ ID NO: 415846 - DNA, 283 bp, Homo sapiens
ggtcatttgcatcctctagtgaaaagcgaaggaattaaataaaaataacattttgatgcttaatgtttctggcagtattatgtctgtatttaattgttaaaatgtttttcaataattttttccaggttgtctgcattcaaaagagcattctattaaagctaccttaatttggcgcttatttttcttaatcatgtttctgacaatcatagtgtgtggaatggttgctgctttaagcggtaagtgaactgtaatctttattcatctagagagaattatacttgta

SEQ ID NO: 415847 - DNA, 560 bp, Homo sapiens
  misc_feature (39)..(39): n is a, c, g, or t
  misc_feature (42)..(42): n is a, c, g, or t
  misc_feature (51)..(51): n is a, c, g, or t
  misc_feature (61)..(61): n is a, c, g, or t
  misc_feature (289)..(289): n is a, c, g, or t
  misc_feature (293)..(293): n is a, c, g, or t
  misc_feature (298)..(298): n is a, c, g, or t
  misc_feature (333)..(333): n is a, c, g, or t
  misc_feature (552)..(552): n is a, c, g, or t
gtctggccggagcccttgggtgaaattgttaggcgtggnagnagggcagtngaagttcttnccagactcggtgctgtacccgccaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgntganttttnttgttaagtcttagatcatgtctaaatattttttntttgacacacctggacagattgaggtatttatctggtcagctttttggacaattattcatcttgatagctcttttgcatcctcttttccaacatttgtcatcttatgttatggactcatcgagtatgtaccaactctaagttgactcttcttagttccaactatgtctctttttgccttgtcagtcattctttattacaaatatcaagactgctctttncatttgtg

SEQ ID NO: 415848 - DNA, 308 bp, Homo sapiens
tggcgcttcgagtggcgcatcgggtggctcctgggggtgggctgagcagtctgttttagaaagccctccatgtgattctgatgcatagtagcctatgacataattccagaccaggtgaatctcaagatactaatcctcacatcatttgccttctcatatttccctcgtcttgaccatctggtgcctgttatgcagtttaacattctgcagcaataaaagtgttttattataaagtattaattttaatgttctatacttagtgggaaccactggtctcaaaatttgaagctattctttaagaggagaac

SEQ ID NO: 415849 - DNA, 2532 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaacttagtggttctcacattgtggaccaggagcatcagcatcatctggggaattgttcaacttacctcttataacctatgaactcagaaaccctgggggtgggctgagcagtctgttttagaaagccctccatgtgattctgatgcatagtagcctatgacataattccagaccaggtgaatctcaagatactaatcctcacatcatttgccttctcatatttccctcgtcttgaccatctggtgcctgttatgcagtttaacattctgcagcaataaaagtgttttattataaagtattaattttaatgttctatacttagtgggaaccactggtctcaaaatttgaagctattctttaagaggagaac

SEQ ID NO: 415850 - DNA, 2379 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaacttagtggttctcacattgtggaccaggagcatcagcatcatctggggaattgttcaacttacctcttataacctatgaactcagaaaccctgggggtgggctgagcagtctgttttagaaagccctccatgtgattctgatgcatagtagcctatgacataattccagaccaggtgagagtgatcttcgcacgatgggatcctctagaacacta

SEQ ID NO: 415851 - DNA, 2424 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaacttagtggttctcacattgtggaccaggagcatcagcatcatctggggaattgttcaacttacctcttataacctatgaactcagaaaccctgggggtgggctgagcagtctgttttagaaagccctccatgtgattctgatgcatagtagcctatgacataattccagaccaggtgaatctcaagatactaatcctcacatcatttgccttctcatatttccctcgtcttgaccatctggtgcctgttatgcagtttaacattctgcagcaataaaagtgttttattataaagtattaattttaatgttctatacttagtgggaaccactggtctcaaaatttgaagctattctttaagaggagaac

SEQ ID NO: 415852 - DNA, 2384 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaaggccaacgcagagagccaacagcagagagaacaactggaacgccttcgaaaagatatgggttctgtagccttggatgcagggactgccaaagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaacttagtggttctcacattgtggaccaggagcatcagcatcatctggggaattgttcaacttacctcttataacctatgaactcagaaaccctgggggtgggctgagcagtctgttttagaaagccctccatgtgattctgatgcatagtagcctatgacataattccagaccaggtgaatctcaagatactaatcctcacatcatttgccttctcatatttccctcgtcttgaccatctggtgcctgttatgcagtttaacattctgcagcaataaaagtgttttattataaagtattaattttaatgttctatacttagtgggaaccactggtctcaaaatttgaagctattctttaagaggagaac

SEQ ID NO: 415853 - DNA, 1800 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgactcgtggaaatgtccacgggatcctctagat

SEQ ID NO: 415854 - DNA, 1732 bp, Homo sapiens
gacagtgatgccgaagaatatgaaggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaacttagtggttctcacattgtggaccaggagcatcagcatcatctggggaattgttcaacttacctcttataacctatgaactcagaaaccctgggggtgggctgagcagtctgttttagaaagccctccatgtgattctgatgcatagtagcctatgacataattccagaccaggtgaatctcaagatactaatcctcacatcatttgccttctcatatttccctcgtcttgaccatctggtgcctgttatgcagtttaacattctgcagcaataaaagtgttttattataaagtattaattttaatgttctatacttagtgggaaccactggtctcaaaatttgaagctattctttaagaggagaac

SEQ ID NO: 415855 - DNA, 1740 bp, Homo sapiens
  misc_feature (1720)..(1721): n is a, c, g, or t
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacacgaatgttcaggtannagctcggttgtatcatgta

SEQ ID NO: 415856 - DNA, 1731 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccgtcgtagcggatgtccatgggctgtcacacgtgtagagcagtaatagaggactgtcaggtttatgtctatcact

SEQ ID NO: 415857 - DNA, 1705 bp, Homo sapiens
cctacaagtgggaccttattttagctactatgagggaggtattctttctacttataaagaaactacattttgggcagcatgatagagcatgcttctaggagacatttcctttttgagggaagtgagtacttaagtttcttagaagtaatgtactgttttctgatggatgggtgacgggctctaatcagtttgtctaatgaaagagttgaaaaagaattgcccttttttccttgcagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgaccctgcactgtaagttgcccttctattagcagccaaggaaaagggaaacatgagcttatccagaacggtggcagagtctccttggcaatcaaccaacgttgctatgaaatatgcctcacactgtatagctcattataggacgtcaggtttgttgaaaaaagtgggcaagacatgattaatgaatcagaatcctgtttcattggtgacttggataaagactttttaattttaactttgttctaagactgcttgtcatgatttcaaattagaaaattatataattgcaaacagcttcacttctcctgttcaacagaggcttaaggccagatgtccaaacttgtctcaataaggaggtgatattttactaaagtttcccacgtgcacatactgactaaatacagagctaggcccagtttgtattgtactctgaacttaatgcaaagtctccttggtgattttcgcaaagtccgtggatttgggtcagaggcacatttcatacataacagcccttataaacgtttgccctgcctccacattttacagtatcttaaaacagtacatttctttcaaagaattttatctctatgagtcagtactccaacttagtggttctcacattgtggaccaggagcatcagcatcatctggggaattgttcaacttacctcttataacctatgaactcagaaaccctgggggtgggctgagcagtctgttttagaaagccctccatgtgattctgatgcatagtagcctatgacataattccagaccaggtgaatctcaagatactaatcctcacatcatttgccttctcatatttccctcgtcttgaccatctggtgcctgttatgcagtttaacattctgcagcaataaaagtgttttattataaagtattaattttaatgttctatacttagtgggaaccactggtctcaaaatttgaagctattctttaagaggagaac

SEQ ID NO: 415858 - DNA, 1601 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatcttatacaaaaccaagctgcctttcattgtggtcatgaataaaactgacatcattgaccacagctttgcagtggaatggatgcaggattttgaggctttccaagatgccttgaatcaagagactacatacgtcagtaacctgactcgttcaatgagcctggtgttagatgagttttacagctcactcagggtggtgggtgtctctgctgttctgggtactggattagatgaactctttgtgcaagttaccagtgctgccgaagaatatgaaagggagtatcgtcctgaatatgaacgtctgaaaaaatcactggccaacgcagagagccaacagcagagagaacaactggaacgccttcgaaaagatatgggttctgtagccttggatgcagggactgccaaagacagcttatctcctgtgctgcacccttctgatttgatcctgactcgaggaaccttggatgaagaggatgaggaagcagacagcgatactgatgacattgaccacagagttacagaggaaagccatgaagagccagcattccagaattttatgcaagaatcgatggcacaatactggaagagaaacaataaataggagactttagcacacttcacttgtttctagaagtccagaattttggacctccacgtgaaagaactgttcttacctctgaactgggggctcccataagggataattttcctcagagtagcaaagtttctcttattagagaaatcttgtgactcagatgaagtcagggatagaagacccttggacctggcaggttaatgctgattattccttggcctttcccttgtatttatgcaaggaaggatatactgagctgatactcttccaagcctacaacttcaagttttatcatttgaactcaagtacttttgctgctgaggaatggaatcaaaagaacgtagtctcctggtgaccacctcagatctctattattaggctagatgtatagcctctactcccccagcttcttgctcttgacctgtcctgcgaacctatgagagatcctgctagagtcg

SEQ ID NO: 415859 - DNA, 692 bp, Homo sapiens
ggggtgggtggggccaggaggaagatggcggcgtccgcagctgccgctgagctccaggcttctgggggtccgcggcacccagtgtgtctgttggtgttgggaatggcgggatccgggaaaaccacttttgtacagaggctcacaggacacctgcatgcccaaggcactccaccgtatgtgatcaacctggatccagcagtacatgaagttccctttcctgccaatattgatattcgtgatactgtaaagtataaagaagtaatgaaacaatatggacttggacccaatggcggcatagtgacctcactcaatctctttgctaccagatttgatcaggtgatgaaatttattgagaaggcccagaacatgtccaaatatgtgttgattgacacacctggacagattgaggtattcacctggtcagcttctgggacaattatcactgaagcccttgcatcctcatttccaacagttgtcatctatgtaatggacacatcgagaagtaccaacccagtgaccttcatgtccaacatgctctatgcctgcagcatctaatccagtacccagaacagcagagacacccaccaccctgagtgagctgtaaaactcatctaacaccaggctcattgaacgagtcaggttactggcgtatgtagtctcttgattcaaggcatcttggaaagcctcaaaat

SEQ ID NO: 415860 - DNA, 93 bp, Homo sapiens
agtatcgtcctgaatatgaacgtctgaaaaaatcactggtaagaagggaggctgtttgtatattttaaaagggccattaaaaaaacccagctc

SEQ ID NO: 415861 - DNA, 156 bp, Homo sapiens
ttggacccaatggcggcatagtgacctcactcaatctctttgctaccagatttgatcaggtatatctgtctttagtatattaatatggttgtgtaaaatctgtgactcttaaattccttagcttgatcacattggtaaagaagagcagctaacctg

SEQ ID NO: 415862 - DNA, 4528 bp, Homo sapiens
atgctctttgagggcttggatctggtgtcggcgctggccaccctcgccgcgtgcctggtgtccgtgacgctgctgctggccgtgtcgcagcagctgtggcagctgcgctgggccgccactcgcgacaagagctgcaagctgcccatccccaagggatccatgggcttcccgctcatcggagagaccggccactggctgctgcagggttctggcttccagtcgtcgcggagggagaagtatggcaacgtgttcaagacgcatttgttggggcggccgctgatacgcgtgaccggcgcggagaacgtgcgcaagatcctcatgggcgagcaccacctcgtgagcaccgagtggcctcgcagcacccgcatgttgctgggccccaacacggtgtccaattccattggcgacatccaccgcaacaagcgcaaggtcttctccaagatcttcagccacgaggccctggagagttacctgcccaagatccagctggtgatccaggacacactgcgcgcctggagcagccaccccgaggccatcaacgtgtaccaggaggcgcagaagctgaccttccgcatggccatccgggtgctgctgggcttcagcatccctgaggaggaccttgggcacctctttgaggtctaccagcagtttgtggacaatgtcttctccctgcctgtcgacctgcccttcagtggctaccggcggggcattcaggctcggcagatcctgcagaaggggctggagaaggccatccgggagaagctgcagtgcacacagggcaaggactacttggacgccctggacctcctcattgagagcagcaaggagcacgggaaggagatgaccatgcaggagctgaaggacgggaccctggagctgatctttgcggcctatgccaccacggccagcgccagcacctcactcatcatgcagctgctgaagcaccccactgtgctggagaagctgcgggatgagctgcgggctcatggcatcctgcacagtggcggctgcccctgcgagggcacactgcgcctggacacgctcagtgggctgcgctacctggactgcgtcatcaaggaggtcatgcgcctgttcacgcccatttccggcggctaccgcactgtgctgcagaccttcgagcttgatggtttccagatccccaaaggctggagtgtcatgtatagcatccgggacacccatgacacagcgcccgtgttcaaagacgtgaacgtgttcgaccccgatcgcttcagccaggcgcggagcgaggacaaggatggccgcttccattacctcccgttcggtggcggtgtccggacctgcctgggcaagcacctggccaagctgttcctgaaggtgctggcggtggagctggctagcaccagccgctttgagctggctacacggaccttcccccgcatcaccttggtccccgtcctgcaccccgtggatggcctcagcgtcaagttctttggcctggactccaaccagaacgagatcctgccggagacggaggccatgctgagcgccacagtctaacccaagacccacccgcctcagcccagcccaggcagcggggtggtggttgtgggaggtagaaacctgtgtgtgggagggggccggaacggggagggcgagtggcccccatacttgccctcccttgctccccctccctggcaaaccctacccaaagccagtgggccccattcctagggctgggctccccttctggctccagcttccctccagccactccccatttaccatcagctcagcccctgggaagggcgtggcaggggctctgcatgcccgtgacagtgttaggtgtcagcgcgtgctacagtgtttttgtgatgttctgaactgctcccttccctccgttcctttcggacccttttagctggggttgggggacgggaagagccgtgcccccttgggcgcactcttcagcgtctcctcctcctgcgcccccactgcgtctgcccaggaacagcatcctgggtagcagaacaggagtcaaccttggcggggcgggggctgcgtccaacctggagattgcccttccctatgccacggttcccaccctccctcaccagtttggacaatttgaaattacctattgctgctacttgttctgtcctctgaccttggggcaaaggagccccaggccctgtctccccagcatcctccctggtggccctgggcaggtgcactgacacccccaccttcccatcccctgctgaaccaggccctgttacacacagccgcctaaggcccgcggctcatgtgctgcccgcccccatatttattcactgatagagaatcttggggatgctggggtctggagtgaacatctcctccccttcatgccctagcctgtgttctagctgtcctggcgagacttctgtgagtgaagaggaaggggtctctggtcaaacccagcccccagggcctagggttgaaagccttccccggctccgggcattatttgggtttaatctcggagcctcactcctggactgaagtccggtgcctctgccttatccctggtggagatggaatgtggcccattgcctcctccctctcctgtcaaaaaccctgatcaggtagatttggaggcggccacgatttcctgtttggcccctgttcaccccagtgcactggccctgactccaggcgtgagtatggggaaggatacgggttcttctgacggggagcaagggcctccgtcttcccttccttaactctccccctttgccctccgccctgaaaaaggtgtccttgaagtcccttccacctctatgccactgtctgcttagcccagctcaggggtggggaagaggcgaaagcgtgggggaggtgagcgcagcggcagttctgcctcggagctgattgcagggccctgtgtggtctccggacagctgcgggaaggctgccgcagctgaagctgaagaggcggctacgtgcggtttgtcagggggattgggttgaaaactggccagtcgggatgactgggtgaaagaggagtagctcctgccactggcgttttgagtgttggcaatttgggatgcctcctggggaaggtttccgggcgtttggtgagtctctagatttttccttgctttctgtgtttattggtttttgatgttgtaaaagcaatgaatcccctttacaagaaaatcgaaaacacagaagaatgaaggacatgccagtccccgatcgctgctgtgagcacctcagtggctccctcagaccagatcccgtaggcagccccacagaccgaccctgaccccactcacagccaccctgaagatagactataggaacgggcccataccacacagactgctctccaatccctgagtctcagatgtttcatttatttcctacttttccactactaaaaaacagtgtggaatagacattattggcaaaattgctcatccctaatcctgaaaaacaggccagaatgggtaaagacttgtcaaagcttgcaacatagctacatggtgcacccggacctgtaccccctccccccaacacaaaaccagtgtctgggaggttcattttcctttaaactgatccagctggccctgaaccaattgtttttgactgagtatctaggagagcagtaagtggaacttcagacaagcccactgggtctggtccaggtgaggggcagggggcatggggctgggaggtctcaggggccttccctgggggtggccagcctggtagggggcagagaaggaaaagctgaggggggtccctgtgagggaggaaagaaggatcatttgccccgctgggtctcaaaggcagtgagaagagagctgaagaaagctctggctggctgacaggatccctgtgttgtaattggtccctcctttcagctctctagtgagatgcccgtgtctgtgcgtgtgcgtgtgtgtttcatacagctagcattagatgggtgatgtttcttacttatcatccctaactattgcaacttgaccttaaaaagacaaaaccccacaaaactcttcctgccacgggcttgcagattgaagcactttcgatgttgggcgctggcgtttgtgttctgggcaccaccgtgaccctgcccagatggctataatattattttatacacaaaccttttttttcataaatgttataattttgtgtctgtctttataaactattataagtactatttttgttataattcaaaatagatatttagtataaagtttttgctgttaaatatttgttatttagtaaaatatgaattttgctctattgtaaacatggttcaaaatattaatatgtttttatcacagtcgttttaatattgaaaaagcacttgtgtgttttgttttgatatgaaactggtaccgtgtgagtgtttttgctgtcgtggttttaatctgtatataatattccatgttgcatattaaaaacatgaatgttgtgcattttgtgattttggaaatactcaatgtggctcttctataggcttctagaataaaccgtggggacccgc

SEQ ID NO: 415863 - DNA, 2154 bp, Homo sapiens
agcgggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgtattttaagtaaattaagagttaatgtaaatttcttaattagaatattattacttgagggattactttatgtcaagaagtttaaaaatagttaaaaccctaacaatagaagtggattaacacaaaagagaagtgtgatcatggtaattaggtgagtcctttgtggcagaaagcaaagtaaggtcactaattgtatatcagtggcatcattttgattgtaagtgatttaggcatataggtaggaattgtctatagacattttattcaatatcctatttatgtcctttttattttttgccctttttaactcttgaaaaaattttaaatctcatgcatagaaaagttacagataatttttttctttctgaaccatttgtgatttagttgaagacatgattcctcattactgattactatctgcttcaaattatcttacatgactacaatgcaaccattagaatcaggaaatttacgttgacacattactaccctctaatcctcagatcttcacttcattcacattgaactgattgtcccaataatgtccatatagcaagaggatccagtcagaatcatgcctttcatttagatgtcagctgtctttagtttacttcattctggaacaaattctcatttgtttccttttacaacttagtacttttgacaattatgggctagttttgtagaacaccccttattttgagttctgtctgatacttcatgattagattgaggttattcatctttggcaggaatgtgatagaagtgcatcctgtcattgtttaataatttcagtttgtctcatttctgatggtgtttcttagatgactgattaaggtagtgtctgccagacttctccactgtagttatttttataattatttcttgagaagatagttgcaaaatactaccttgtttctgatcagactttaaatttatcgtatctctataaactcattattttctattttattcagcaggttaaaaaacctattatcattacattggtgctcaaaattattgtacatttggctggtagaagtccattctgggtggcctctgtgtccttctgacacattcccatcattattcaatgaatttgttactctctgg

SEQ ID NO: 415864 - DNA, 1142 bp, Homo sapiens
agcgggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagttaattttccccaaaggcacccttcatttcacatgatctatactctaatgttcttttgtattaaaaatatggttaaatatggaattagtaaaatgcagcgtcgacgcggg

SEQ ID NO: 415865 - DNA, 2689 bp, Homo sapiens
agcgggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaaggtagcggcagctcggggcttgtgttcagtttcctcttcccagacgcccccagccccgtttccctgaacgactgttgggtgtcccgacggctcctgtggctggcagaaagagaaagaggataacactgaccaggtttgggtctggtcagagcccccgcctcttcagggcaggtgctgagttgtggaaatttgaggagcctattttcgtgtttagttttcaaactaagactgctgcttctgcttctctgacgggcttcagctgggaacagattaactaggttgctaaaggaacaaatatttcttccgtgcactgaagacaggcaggaagacaacagataacgtacctgcagtggagaggttaagctcctgtacggaagcgtaattcataaatagataaatataggaaaggacaacaaagaaaatagggatagaataacgggcagagaatttagagatgatgtcaggtgattagttttctcatctaaaagcttgaaaatcctgcatgtttgtggagtggtcaagcaggtggtgaagagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgtattttaagtaaattaagagttaatgtaaatttcttaattagaatattattacttgagggattactttatgtcaagaagtttaaaaatagttaaaaccctaacaatagaagtggattaacacaaaagagaagtgtgatcatggtaattaggtgagtcctttgtggcagaaagcaaagtaaggtcactaattgtatatcagtggcatcattttgattgtaagtgatttaggcatataggtaggaattgtctatagacattttattcaatatcctatttatgtcctttttattttttgccctttttaactcttgaaaaaattttaaatctcatgcatagaaaagttacagataatttttttctttctgaaccatttgtgatttagttgaagacatgattcctcattactgattactatctgcttcaaattatcttacatgactacaatgcaaccattagaatcaggaaatttacgttgacacattactaccctctaatcctcagatcttcacttcattcacattgaactgattgtcccaataatgtccatatagcaagaggatccagtcagaatcatgcctttcatttagatgtcagctgtctttagtttacttcattctggaacaaattctcatttgtttccttttacaacttagtacttttgacaattatgggctagttttgtagaacaccccttattttgagttctgtctgatacttcatgattagattgaggttattcatctttggcaggaatgtgatagaagtgcatcctgtcattgtttaataatttcagtttgtctcatttctgatggtgtttcttagatgactgattaaggtagtgtctgccagacttctccactgtagttatttttataattatttcttgagaagatagttgcaaaatactaccttgtttctgatcagactttaaatttatcgtatctctataaactcattattttctattttattcagcaggttaaaaaacctattatcattacattggtgctcaaaattattgtacatttggctggtagaagtccattctgggtggcctctgtgtccttctgacacattcccatcattattcaatgaatttgttactctctgg

SEQ ID NO: 415866 - DNA, 3021 bp, Homo sapiens
agcgggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaaggtagcggcagctcggggcttgtgttcagtttcctcttcccagacgcccccagccccgtttccctgaacgactgttgggtgtcccgacggctcctgtggctggcagaaagagaaagaggataacactgaccaggtttgggtctggtcagagcccccgcctcttcagggcaggtgctgagttgtggaaatttgaggagcctattttcgtgtttagttttcaaactaagactgctgcttctgcttctctgacgggcttcagctgggaacagattaactaggttgctaaaggaacaaatatttcttccgtgcactgaagacaggcaggaagacaacagataacgtacctgcagtggagaggttaagctcctgtacggaagcgtaattcataaatagataaatataggaaaggacaacaaagaaaatagggatagaataacgggcagagaatttagagatgatgtcaggtgattagttttctcatctaaaagcttgaaaatcctgcatgtttgtggagtggtcaagcaggtggtgaagaggtgtgtgcataaaataagtagtactccttttatttcttttcaccaatgctctttggatctggacccgctttttctttgttaagtgtataattaaactaacaggttgaaattagatttagttctcaggttagatgcccaagatgtttgatggcagtgtaatatggtgaagggagactacttgtttcctagttttgtaaacttgggcgagagattgttcagtgtctctatatcttccttatccacaagataaggtagttatagtacccttctcatgggattgttttgagcttaacatggtattcacgtgtatgaagagcttggagtattcactgggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgtattttaagtaaattaagagttaatgtaaatttcttaattagaatattattacttgagggattactttatgtcaagaagtttaaaaatagttaaaaccctaacaatagaagtggattaacacaaaagagaagtgtgatcatggtaattaggtgagtcctttgtggcagaaagcaaagtaaggtcactaattgtatatcagtggcatcattttgattgtaagtgatttaggcatataggtaggaattgtctatagacattttattcaatatcctatttatgtcctttttattttttgccctttttaactcttgaaaaaattttaaatctcatgcatagaaaagttacagataatttttttctttctgaaccatttgtgatttagttgaagacatgattcctcattactgattactatctgcttcaaattatcttacatgactacaatgcaaccattagaatcaggaaatttacgttgacacattactaccctctaatcctcagatcttcacttcattcacattgaactgattgtcccaataatgtccatatagcaagaggatccagtcagaatcatgcctttcatttagatgtcagctgtctttagtttacttcattctggaacaaattctcatttgtttccttttacaacttagtacttttgacaattatgggctagttttgtagaacaccccttattttgagttctgtctgatacttcatgattagattgaggttattcatctttggcaggaatgtgatagaagtgcatcctgtcattgtttaataatttcagtttgtctcatttctgatggtgtttcttagatgactgattaaggtagtgtctgccagacttctccactgtagttatttttataattatttcttgagaagatagttgcaaaatactaccttgtttctgatcagactttaaatttatcgtatctctataaactcattattttctattttattcagcaggttaaaaaacctattatcattacattggtgctcaaaattattgtacatttggctggtagaagtccattctgggtggcctctgtgtccttctgacacattcccatcattattcaatgaatttgttactctctgg

SEQ ID NO: 415867 - DNA, 954 bp, Homo sapiens
agcgggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaatagg

SEQ ID NO: 415868 - DNA, 2324 bp, Homo sapiens
agcgggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaaggtagcggcagctcggggcttgtgttcagtttcctcttcccagacgcccccagccccgtttccctgaacgactgttgggtgtcccgacggctcctgtggctggcagaaagagaaagaggataacactgaccaggtttgggtctggtcagagcccccgcctcttcagggcagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgtattttaagtaaattaagagttaatgtaaatttcttaattagaatattattacttgagggattactttatgtcaagaagtttaaaaatagttaaaaccctaacaatagaagtggattaacacaaaagagaagtgtgatcatggtaattaggtgagtcctttgtggcagaaagcaaagtaaggtcactaattgtatatcagtggcatcattttgattgtaagtgatttaggcatataggtaggaattgtctatagacattttattcaatatcctatttatgtcctttttattttttgccctttttaactcttgaaaaaattttaaatctcatgcatagaaaagttacagataatttttttctttctgaaccatttgtgatttagttgaagacatgattcctcattactgattactatctgcttcaaattatcttacatgactacaatgcaaccattagaatcaggaaatttacgttgacacattactaccctctaatcctcagatcttcacttcattcacattgaactgattgtcccaataatgtccatatagcaagaggatccagtcagaatcatgcctttcatttagatgtcagctgtctttagtttacttcattctggaacaaattctcatttgtttccttttacaacttagtacttttgacaattatgggctagttttgtagaacaccccttattttgagttctgtctgatacttcatgattagattgaggttattcatctttggcaggaatgtgatagaagtgcatcctgtcattgtttaataatttcagtttgtctcatttctgatggtgtttcttagatgactgattaaggtagtgtctgccagacttctccactgtagttatttttataattatttcttgagaagatagttgcaaaatactaccttgtttctgatcagactttaaatttatcgtatctctataaactcattattttctattttattcagcaggttaaaaaacctattatcattacattggtgctcaaaattattgtacatttggctggtagaagtccattctgggtggcctctgtgtccttctgacacattcccatcattattcaatgaatttgttactctctgg

SEQ ID NO: 415869 - DNA, 1148 bp, Homo sapiens
agcgggagaggccgaggcgtagcctaagcgtgggattccgcgcgtgcgctcggctccgcctggtgcggccgcggccgggagggactggattatgtcggccccgtttgaggagcggagtggggtggtaccgtgcgggaccccgtggggccagtggtaccagaccttggaggaggtgttcattgaagttcaggtgccgccaggcacgcgcgcccaggatatccagtgcggcctccagagccggcatgtggcgctgtcggtgggcggccgcgagatcctcaagggcaaactctttgattctacaatagctgatgagggaacatggactttggaggacagaaaaatggttcgtattgttcttacaaagacaaagagagatgcagcaaattgttggacttctctactagaatctgaatatgcagcggatccttgggtgcaagaccaaatgcagagaaagcttacattagagagattccaaaaagaaaatcctggttttgacttcagtggagcagaaatctcaggaaactacactaaaggtggaccagatttctcaaaccttgagaaataactgctttttttcctgcattctgtggatcctagcagatattgccaacttaatcagataaacagattatgtaatggaagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggggaaaaaaaaaaaaaaaaaaaaaaaaaaaaaagaaaaaaaaaaaacaaaaagaagaagccgaaacaaggaagaaaaaataataaatgggggagacccaccacttatgggaacccacgaggaggcccccctaacagggggtcgcccctccaacgacggggcccccccccgcgcgcccccgcggccgggccttgaa

SEQ ID NO: 415870 - DNA, 1713 bp, Homo sapiens
  misc_feature (42)..(42): n is a, c, g, or t
  misc_feature (173)..(173): n is a, c, g, or t
ttcccttcccacaaaaacccccttttggaaggaagaaaattnaaggcttgggctttgtgtattttttccccttgcccatttttgcttgggttgggaaattgcccctaaagcccaagaattaatttggcccaaagcttaaattcgagaattaaaaccaaggaatttaattggtnaaattgggaaaggaaaaaatgccggaatggcctaccagtttaaacccagattttggcccaaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggtgcctttggggaaaattaactttttcttttgataagtatgatattcaataaaattttctaaataggaattgtgtacccctttgtctaagtataacaattcacacaaaattatagtgctgaaaacaattttaataaaggaaaaagtccataaatgtattttaagtaaattaagagttaatgtaaatttcttaattagaatattattacttgagggattactttatgtcaagaagtttaaaaatagttaaaaccctaacaatagaagtggattaacacaaaagagaagtgtgatcatggtaattaggtgagtcctttgtggcagaaagcaaagtaaggtcactaattgtatatcagtggcatcattttgattgtaagtgatttaggcatataggtaggaattgtctatagacattttattcaatatcctatttatgtcctttttattttttgccctttttaactcttgaaaaaattttaaatctcatgcatagaaaagttacagataatttttttctttctgaaccatttgtgatttagttgaagacatgattcctcattactgattactatctgcttcaaattatcttacatgactacaatgcaaccattagaatcaggaaatttacgttgacacattactaccctctaatcctcagatcttcacttcattcacattgaactgattgtcccaataatgtccatatagcaagaggatccagtcagaatcatgcctttcatttagatgtcagctgtctttagtttacttcattctggaacaaattctcatttgtttccttttacaacttagtacttttgacaattatgggctagttttgtagaacaccccttattttgagttctgtctgatacttcatgattagattgaggttattcatctttggcaggaatgtgatagaagtgcatcctgtcattgtttaataatttcagtttgtctcatttctgatggtgtttcttagatgactgattaaggtagtgtctgccagacttctccactgtagttatttttataattatttcttgagaagatagttgcaaaatactaccttgtttctgatcagactttaaatttatcgtatctctataaactcattattttctattttattcagcaggttaaaaaacctattatcattacattggtgctcaaaattattgtacatttggctggtagaagtccattctgggtggcctctgtgtccttctgacacattcccatcattattcaatgaatttgttactctctgg

SEQ ID NO: 415871 - DNA, 543 bp, Homo sapiens
cataaatagataaatataggaaaggacaacaaagaaaatagggatagaataacgggcagagaatttagagatgatgtcaggtgattagttttctcatctaaaagcttgaaaatcctgcatgtttgtggagtggtcaagcaggtggtgaagaggtgtgtgcataaaataagtagtactccttttatttcttttcaccaatgctctttggatctggacccgctttttctttgttaagtgtataattaaactaacaggttgaaattagatttagttctcaggttagatgcccaagatgtttgatggcagtgtaatatggtgaagggagactacttgtttcctagttttgtaaacttgggcgagagattgttcagtgtctctatatcttccttatccacaagataaggtagttatagtacccttctcatgggattgttttgagcttaacatggtattcacgtgtatgaagagcttggagtattcactggtatgtaataagttcatactatatgttagctattagctattatatatattacagtatat

SEQ ID NO: 415872 - DNA, 5997 bp, Homo sapiens
gtgtgggactgccgctctgcgcggcgagaggtggcctgggaatggccgggccgggggtgggccggagccgctgtggcggcggcggcggctgggggcggtgagcgcggcgtggggctgcccctccccggaggcggcgggggcggccggggccgcgccgcaccgcaccgcgcgggcggccatggagcgagcctagggcccgacaggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacaggacagggtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtctttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcacctgttgcccaggctggagtgcagtggcacgatcttggctcactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcagctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgaact

SEQ ID NO: 415873 - DNA, 5583 bp, Homo sapiens
ctaccttttatctgtactaaaactacatcaaaagccctttagtggggcaaaaatgacagcttccatgttttattcttagaatgattggtgacgtagatagagaattctagtttccttctctacctcatcttcattccatctaccggcaattcatgctaatccacagttgtttgcagggttgacagagaaggtgactatagcagaatcaggcttgctaatgggtgtattctaccacttgtgctgtcacctgttactggtgtaatccacgtatacatctgtgcttcccattcactttgcaggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacaggacagggtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtctttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcacctgttgcccaggctggagtgcagtggcacgatcttggctcactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcagctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgaact

SEQ ID NO: 415874 - DNA, 4188 bp, Homo sapiens
gtgtgggactgccgctctgcgcggcgagaggtggcctgggaatggccgggccgggggtgggccggagccgctgtggcggcggcggcggctgggggcggtgagcgcggcgtggggctgcccctccccggaggcggcgggggcggccggggccgcgccgcaccgcaccgcgcgggcggccatggagcgagcctagggcccgacaggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacaggacagggtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtctttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgaact

SEQ ID NO: 415875 - DNA, 5638 bp, Homo sapiens
ctaccttttatctgtactaaaactacatcaaaagccctttagtggggcaaaaatgacagcttccatgttttattcttagaatgattggtgacgtagatagagaattctagtttccttctctacctcatcttcattccatctaccggcaattcatgctaatccacagttgtttgcagggttgacagagaaggtgactatagcagaatcaggcttgctaatgggtgtattctaccacttgtgctgtcacctgttactggtgtaatccacgtatacatctgtgcttcccattcactttgcaggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatgtaagttatgcacagcaaatacatgtgcctgcattgccttcttttccaggctcagcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacaggacagggtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtctttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcacctgttgcccaggctggagtgcagtggcacgatcttggctcactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcagctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgaact

SEQ ID NO: 415876 - DNA, 1018 bp, Homo sapiens
tgcaacagggggcaatgccttattaatacattcttgaataatactctgagcaaatcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgaact

SEQ ID NO: 415877 - DNA, 842 bp, Homo sapiens
aaaaaaaaaaaaaaaaaaaagaaaaaaaaaaaaaaaaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgaact

SEQ ID NO: 415878 - DNA, 6035 bp, Homo sapiens
  misc_feature (5967)..(5967): n is a, c, g, or t
  misc_feature (5977)..(5978): n is a, c, g, or t
  misc_feature (6002)..(6003): n is a, c, g, or t
  misc_feature (6011)..(6011): n is a, c, g, or t
  misc_feature (6018)..(6018): n is a, c, g, or t
  misc_feature (6020)..(6020): n is a, c, g, or t
gtgtgggactgccgctctgcgcggcgagaggtggcctgggaatggccgggccgggggtgggccggagccgctgtggcggcggcggcggctgggggcggtgagcgcggcgtggggctgcccctccccggaggcggcgggggcggccggggccgcgccgcaccgcaccgcgcgggcggccatggagcgagcctagggcccgacaggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacaggacagggtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtctttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcacctgttgcccaggctggagtgcagtggcacgatcttggctcactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcagctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctaatttattgctgagagggggaggggcccccccgctccctttttgttggagccgaggacggcgggcgcggcgagagccggcaacgaaaggagacgcacacgcccgtcgtcacgctctcgaccgtatgtccatgtggtgtgtgggcgtcccgtggcgccgcggcgcgcccggacgcgcgccccgncggcccaaanncacaccaaattatttatggggggnngggcgggntgattgnantagggaaaaagaaga

SEQ ID NO: 415879 - DNA, 5943 bp, Homo sapiens
gtgtgggactgccgctctgcgcggcgagaggtggcctgggaatggccgggccgggggtgggccggagccgctgtggcggcggcggcggctgggggcggtgagcgcggcgtggggctgcccctccccggaggcggcgggggcggccggggccgcgccgcaccgcaccgcgcgggcggccatggagcgagcctagggcccgacaggaactgtggaaggtgcatcagtgaagaaatggaccaatgtgtataatcatggaatctccttgctaaccatcaccaccagctctccttaatacatgagcaagagtgggtcaggggagaaggaaaagaggtcaacatgaagctaaagcagcgagtcgtgctgttagcaattctccttgtcatttttatcttcaccaaagttttcctgattgacaacttagatacatcagctgccaaccgggaggaccagagggcctttcaccgaatgatgactggcttgcgggtggagctggcacccaagctggaccataccttgcagtctccctgggagattgcagcccagtgggtggttccccgggaagtgtaccctgaagagacaccagagctgggggcagtcatgcatgccatggccaccaagaaaatcattaaagctgatgtgggttataaagggacacagctgaaagccttactgatacttgaaggaggccagaaagttgttttcaaacctaagcggtatagccgagaccatgtggtggaaggggaaccgtatgctggttatgatagacacaatgcagaggtagcagcctttcacttggacaggattctgggtttccaccgagcccccttggtagttggcagatttgttaatcttcggacagagatcaaacctgtcgccacagagcagctgttgagcaccttcctaactgtaggaaacaatacttgtttttatgggaagtgctattactgccgagaaacagaaccagcttgtgctgatggagacataatggagggatctgtcacactttggcttccagatgtgtggcctctgcagaagcaccgtcacccatggggcaggacttaccgagaaggcaaattggccaggtgggagtatgatgagagctactgtgatgctgtgaagaaaacgtccccttatgactctggcccgcgcctcttggacatcattgacacagctgtctttgattacctgattggcaatgctgaccgccatcactatgagagctttcaagatgatgaaggcgctagtatgctcatccttcttgataatgccaaaagctttgggaacccctcgctggatgaaagaagcattcttgcccctctctatcagtgttgcatcattcgggtgtccacctggaacagactgaactacctaaagaatggtgtgctaaagtctgccttaaaatctgccatggcccatgaccccatctccccagtgctctctgatcctcatctggacgccgtggaccagcggctcctgagtgtcctggccaccgtgaagcagtgcaccgaccagtttgggatggacacagtactggtggaagacaggatgcctctctcacacttgtaattctcgacacaaaataagtgaaacttctttttacaaagatagagaaacagcacaatcaattccaaatggtatgagatggattggaagtggccagcagcaagttctggtgacaggacagggtggccttggatgtctttggtattttctgtagtagaaactaaagcaaagaccacaagtttcagagcatggagacattcctgctgaatcgccttctcacctcctcggcaattgctcattctagggttgggcatcatagttggtcagtcttaattcccatgccaaaggacaaacaggtgtgacatttggatagatgaatactgggattggctctggagcatgtgttttgagttgaaccttgcagtcctttctctacgcccgtggattttgtggaaacactttgcaatctctttgtctttttttttttaccagaactagttacattggaatgcttactgtcctacagagtggcagcaaataaaaccttgcattccatcaagccaaaatagcacactctgttagaggagatacatgtttaagatagaattggagggaaggacaaaaacagaaaaatgtttgggcttttaagccattgggtagtattgttttgatgatcttagaggagggaagaagagagagagacccaatggtagaaccagaatcagggagatgactgaactactgaaaaacaggttcccttgtatttaggatcttaaggtgtataaaaagcaaacatgactttgcacctaagtaaattctgcattctcatagttgtgtcccaattaaccaaaaagttgtctctagagaaaatactattacaatctaagcatgattctctgtggagactaattttttccccttttgccaaaagcagtccttcccaaattaacaaagcaaactgaaataataccttgaataacaggttgcctgtggtctctgtcatcctcgtttctcttctgaaatgaatttccacctctgcctttaaggcatttttgtcactgaagctgctgttcccaagagatcggcaacctttttgtccctttctcataagaaagggacactcctacaggtgagagtgtataccttactctctcagataagtggctggacttatcttgtgatttggggccatggaagattggaaacaaagattttaagccttcttctttttttcttttttcttttttttttgagaccaagtctcacctgttgcccaggctggagtgcagtggcacgatcttggctcactgcaacctccgtctcccaggttcaagcgattctcttgcctcagcctccagagtagctgggattacaggcgcccgccatcgtgcccagctaatttttatatttttagtggagacagggtttcgggtttcaccatgttggccaggttgatcttggactcctgaccccaggtgatccacctgcctcagccttccaaagtgctgggattacaggcatgagccaccgtggccggccaagattttaagccttctgagccttgaaattgaggaggttaaaaggaagagccttaagattttgatttatgtcaaatcctaattctatcattcagtcttgtttggagttctgaacccatgatgttgtattatgcttctttctcctcttagcactctcaaatttcaggtttgtaaaacacagtttttgttttgtgttctggcaaagtgatctcaacatgtaagtagttgcagtaaaacacaggggcaaaggaagacaggcctgatgtgcccactcatctatggactcagagctgtgtgctttgctcctgcatcttgttgaggtgctgttccagctttgcatttctgtcaagtagaggcgaatatataaacagtgtggttgaatacatttaatgccagccattggaaactagttttaggcaaccactctcaaaaacagctttagaatttatgcccagttttcttgcattgaaagataactgagtaataacctgtaactatttttaaatggcatgaaattaggaaacttttgtacattttatatacattttgagatgaacagaacaatgggctgagttataaaaagcgtgtattgaatttaagaagacagactagcacaaaacacagaattcgtgttaaccaaaggaggcattgatttcagttttaaggctactcagtgttgtgtgtccagggaaattcacagctcagtatgagaataccttggttagtgctcacccacaagcttccaggagccagctgggaggagacaataggaagagatgtcagctctgctctccctgtaaatgttagttgaactaagttatggatttgtggtctttcaaatacatgacgcctttagtatgccacactgaaatgaataagaagtcttctgaaactgggaacttcataacattgaaggcagaagattctgctaaggaaaaaagcaggcaggaaagaaaatgtctcatcctttcttgaaagcatttgcagaaaatatatcatttcattttattcccatctgttttcaaactcgtgatcttaaaaggcattctgatgataaatttagaattttcatctataaaatttagaactctaatccataaagttagaattgagctaatagagtggtatgacatggcactaaaaatataaatttttgttgtaagtcaggattggagtaagctggaaaagtatgtttaggcaaatcttggagaaaaccaaccataaacttacagctctaaaattcagaaagccctaaaatttcaaacactgtttgaaagaagaggtgggggccgggtgccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactatttttcccttcaattcctcaagtctgggtggtgacaaggtaggggctaggtactggactaccacaggtttttaggaactaaggtgtttctcataaacacaaaatgttgggtgaaactgggaacaactactcagaagctaatttatttgcttaaatggaaagtgtgggagccactaccctctcttttgatctgccaaggatttcctctcagagctgttgcacagacagagattgtacttggtaagataccaaacaagacagatatggatctaaatttctaatgtgttctatgggtttcaattctgaaaaaagaaaatgaataaagattttaataaatattgatatctgaact

SEQ ID NO: 415880 - DNA, 2076 bp, Homo sapiens
gcggcgagactgcacctcccagcatgccattgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccgataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaat

SEQ ID NO: 415881 - DNA, 743 bp, Homo sapiens
cctgcttttagatattttaagataaaagcaccaggaaattcatgattgcatctctgtgttctaattcaagctatttttttcttccaaggtactttgtttgcaagaagttcaagaagatcattatggagcagagatcaggccaagtttggaatcactgggtacaatgcaactttttttttttttttttcttttttgagacagggtctcactctgtcgcccaactggagtgcagtggcacaatcatggctcactacagcctcaacctactgggctcaagtaatcctctcatttcggcttcctgagtagctgggactagagatgtgtgccaccatgcccggccaattatttaattttttttatagagacaaggcaatgtaacttttagccaaatttacttttgaaaattcatgtgtcattaaagtataacttgctgacaaagatgtgtggcatattttggctaaaaatcttaattttaaaaacttaatttcaaagaggaaaagattgaggtactcactggaaacttttgtgttggtgtataattttaattcaaacagaaagatgtgtaagaatatcttagtagctccctttcctaggagttgttctgtccacctgtagacctataagcttctgagctccaggagaccattttgtctcgttcatcattataataccagtgcctgccagtgtctacctaatggatagatgccaaaaacctgtttgataaataaacactcctagaaaca

SEQ ID NO: 415882 - DNA, 436 bp, Homo sapiens
cctgcttttagatattttaagataaaagcaccaggaaattcatgattgcatctctgtgttctaattcaagctatttttttcttccaaggtactttgtttgcaagaagttcaagaagatcattatggagcagagatcaggccaagtttggaatcactgggtacaatgcaactttttttttttttttttcttttttgagacagggtctcactctgtcgcccaactggagtgcagtggcacaatcatggctcactacagcctcaacctactgggctcaagtaatcctctcatttcggcttcctgagtagctgggactagagatgtgtgccaccatgcccggccaattatttaattttttttatagagacaaggcaatgtaacttttagccaaatttacttttgaaaattcatgtgtcattaaagtataacttgctgaca

SEQ ID NO: 415883 - DNA, 493 bp, Homo sapiens
ttagttcaaagcgatagatgatttgtatgtccaaattaaagaaaagcatgtatgggaaaaagattgtcatttttatgtaaatgataagtgctttctgaattgtatttaaagaaaagaagattttataagtccaaagaatcacttaatacaatgaataaagggtaataatttaccacttttggattaccttttatttaagacataaatttttcaactcataagctatttaaaatcttttcacttaagatacctgttgaaattttgtttaggtatctggccaggaacagtcttcacggggacaaagaattttatctattccaatttggcccccaaacctaggtatctcacagaactgtgtgtatgaggtacagcaggtaccaaaagtagaaaagacaggtaagtgtttgtaatacattttggcagtctgctgggtaatcatgttccctttgaagacataaaactaagtttttaaaaagaaaaaatctcagggatg

SEQ ID NO: 415884 - DNA, 481 bp, Homo sapiens
  misc_feature (472)..(472): n is a, c, g, or t
cacgaggattttttttcttaagacctctaaatttacctttttaaagttgaacttccagaattatctgtgcatgatttacttgcatgttgctttggaattgtttgcatttttctatttttcctaattctggaggccatcgaaatatatagattccagaatgaaacatgtaactaggcatctttctaacctagataagtcttaaatattgtttctagagtaagatgacgatattaaggcaaactagaacaataacattaatatattttcctctattcttacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattccagaagatgagancggtacccg

SEQ ID NO: 415885 - DNA, 2689 bp, Homo sapiens
tagcatcgagtcggccttgttggcttactgtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 415886 - DNA, 4706 bp, Homo sapiens
gaagagggtctgggcgatggtgcatccgggacgagcctccagagaccaagcgggataggtaaacccgccgcgcagctggcgggacgctgggccaacgaggtctggggtcttggcgcggagttcatgggccgccggccaggcttgtgccagtggctttggatccctggcctgcttcccccaacccagcctccagaccagcgctggcctgctccacacactccgcagcaccgtcccgggaaccgagcgtcggcggggaggccgcctctccgcaataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 415887 - DNA, 4651 bp, Homo sapiens
gcggcgagactgcacctcccagcatgccattgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccgataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 415888 - DNA, 4325 bp, Homo sapiens
gcggcgagactgcacctcccagcatgccattgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 415889 - DNA, 3938 bp, Homo sapiens
tcaaacgttttttattccaatgtttattgacatcctacattactaatgttttgcagaatacagtttggtaaacattgttcagaagtatcaggtgagctgtgttttgataaatatataaaagcagtcatttgttttaaattcatttgtttcttgtaggttatcactgtgaatataagatgcggacaggaaggaaacctgatggctgtgctatttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtagcaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 415890 - DNA, 3514 bp, Homo sapiens
cacgaggattttttttcttaagacctctaaatttacctttttaaagttgaacttccagaattatctgtgcatgatttacttgcatgttgctttggaattgtttgcatttttctatttttcctaattctggaggccatcgaaatatatagattccagaatgaaacatgtaactaggcatctttctaacctagataagtcttaaatattgtttctagagtaagatgacgatattaaggcaaactagaacaataacattaatatattttcctctattcttacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 415891 - DNA, 3629 bp, Homo sapiens
ttagttcaaagcgatagatgatttgtatgtccaaattaaagaaaagcatgtatgggaaaaagattgtcatttttatgtaaatgataagtgctttctgaattgtatttaaagaaaagaagattttataagtccaaagaatcacttaatacaatgaataaagggtaataatttaccacttttggattaccttttatttaagacataaatttttcaactcataagctatttaaaatcttttcacttaagatacctgttgaaattttgtttaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttctactctgcagaaaaggaagatgttgctgggcacccaggagctgaagttgctttggttggtggcttgaaacttctagctagactgtcacttcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcctgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgta

SEQ ID NO: 415892 - DNA, 3033 bp, Homo sapiens
tagcatcgagtcggccttgttggcttactgtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgtttttgaaggggtttgataatgctttttaagttgtacagaatgcttaatccatcttattactgtcctgagccatgtaatatgcctgcatcgtgttggggaaatgtttgggaaatataagccagcataacgtgtaaagctcactctttcaccctggaacagacaagaggtgggcttaatagaggcagagactggggatatacctttgtttccctagcatttttatttatttatttttattttattttattttttgagatggagtttcactcttgttgcccaggctgggggtgcaatggcgcaatctttgctcactgcaacccctgcctcccgggctcaagcgattctcctgcctcagcctctcgagtagctgggattacaggcatgcgtcaccactcccagctaattttgtattttcagtagagacagggtttccccatgttggttaggctggtctcgaactcccaacctcaggtgatccgcccacctcagctctcaaagtgctgggattacaggcgggagccactgcacatggcagcattttttaaaaattcagttttaagatctctggtttaggggagagattttattttactgaaccagttctatagaaatttattttattaggaaatttgtctttggaacaaagtggcagctataaaattatttttgttaagcctcagaaatatgaggaagcctgtaaaactctagtggggagatattaacttggagacctaatgctctgtaaatagtcatttaaactgttggttttagtggttttgtttctaaaatgttttcttttaccgtgatgcaccagtatgagatggtgctgacactttctatgaagtggttatgagcaggtttaataaatcctctatacaagtgtttgaatcaattttaaaacataaaaagtggaaatttccttttttgtagacagtaggaacaaggaattatatgcatttttactaagtagtaattttacactgaattgtaaatgtttttacagtgagttttattaatagaatgcttcaccttaaattggaaaacaataatagtcttggactaagtctttgtactaaagcatttgctataattatttttaaaaaaacaaacagatgaaaacctcagagaaggcatgtggattataagatttgtctagtaaaaattgtaattgaatatgtttaaatatttaatttctcattttggggggtttttatttttttattttttagatggtgtctcacgctatcgcccaggctggagtgcagtggcgcgaactcggctcactgcaacctccgcctcctgggttcaagcaattctccttcctcagcctcccaagtagctgggattacaggcatgcaccaccatgcccagctaatttttgtatttttagtagagatggaattttgccatgttggccaggctggtcttgaactcctgacctcaggggtgatccacccgcctcgggctcccaaagtgctgtgattacaggcatgagccaccatgcctggcctttggggggattttaattacagtattaattatagttctaggatttcccacattttatagtagtagtttgcaggatattatgtgccctaattagcagatatagacattatcaaattataatgatagtataattatccctttttaatattggggaaagaaaaatgaaaattcattagttaattactgctttgtgttgtgtgaatttattaacaaataacattattacatataggtcattgttaacaaacaaacatccctgaaaacctctgtgaaaatttaattttttatatcctgattaatatattgtgactttaggcccatttttcatgtgcttcactttgatagagttaatccataaaattgctctttactttagcttatcaaatgaagtattattttgtggactggaggccaaaaagtcaatgtgagcttctcacaggtttttaaagctccactaaaaataattatccacttgtctttacttttgttgaccagaatagttggtaactctgccagagcctgtacttacctgccaaaaacaattaaatctggttaatgcctgaaaccaaatctctcagtctcaagtgttatactatccaagttttaaatggaaaggtaaactgtggagtaatgaaattttggttttactgtaccttttgctatcaagataatattcatgtttgaaatcttgtctttatttggaatttagttactgtctgcttttaacctttgctttcctaaagaaagtttgagatccagagagttcaagggattggggaaagagaggcgtcaagtcatttgcactttgtacctgtaagttaggtaataaactattatactcgtacttctgtgcctgaaggttttgtggtaggtatactgagatgtataagctgtactgttgcctttactaaactatttcattgccctttgcagccatttttacttaggggtgatgctaaaagatgagtgaattgagatatgtcaaaatagagtgatagagtgtttttaatatagagtctgcagattgtgaaagaagggtgaaagaacgataaataggttcagtagaataaatatataataagaggaccaaaaaaaaaaatcacaccatcttactttttttttttttgagactgagtcttgcactgttgcccaggctggagtacattggcgggatctcagctcactgca

SEQ ID NO: 415893 - DNA, 1509 bp, Homo sapiens
gaagagggtctgggcgatggtgcatccgggacgagcctccagagaccaagcgggataggtaaacccgccgcgcagctggcgggacgctgggccaacgaggtctggggtcttggcgcggagttcatgggccgccggccaggcttgtgccagtggctttggatccctggcctgcttcccccaacccagcctccagaccagcgctggcctgctccacacactccgcagcaccgtcccgggaaccgagcgtcggcggggaggccgcctctccgcaataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggtacaatgcaactttttttttttttttttcttttttgagacagggtctcactctgtcgcccaactggagtgcagtggcacaatcatggctcactacagcctcaacctactgggctcaagtaatcctctcatttcggcttcctgagtagctgggactagagatgtgtgccaccatgcccggccaattatttaattttttttatagagacaaggcaatgtaacttttagccaaatttacttttgaaaattcatgtgtcattaaagtataacttgctgacaaagatgtgtggcatattttggctaaaaatcttaattttaaaaacttaatttcaaagaggaaaagattgaggtactcactggaaacttttgtgttggtgtataattttaattcaaacagaaagatgtgtaagaatatcttagtagctccctttcctaggagttgttctgtccacctgtagacctataagcttctgagctccaggagaccattttgtctcgttcatcattataataccagtgcctgccagtgtctacctaatggatagatgccaaaaacctgtttgataaataaacactcctagaaaca

SEQ ID NO: 415894 - DNA, 1202 bp, Homo sapiens
gaagagggtctgggcgatggtgcatccgggacgagcctccagagaccaagcgggataggtaaacccgccgcgcagctggcgggacgctgggccaacgaggtctggggtcttggcgcggagttcatgggccgccggccaggcttgtgccagtggctttggatccctggcctgcttcccccaacccagcctccagaccagcgctggcctgctccacacactccgcagcaccgtcccgggaaccgagcgtcggcggggaggccgcctctccgcaataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtactttgtttgcaagaagttcaagaagatcattatggagcagagatcaggccaagtttggaatcactgggtacaatgcaactttttttttttttttttcttttttgagacagggtctcactctgtcgcccaactggagtgcagtggcacaatcatggctcactacagcctcaacctactgggctcaagtaatcctctcatttcggcttcctgagtagctgggactagagatgtgtgccaccatgcccggccaattatttaattttttttatagagacaaggcaatgtaacttttagccaaatttacttttgaaaattcatgtgtcattaaagtataacttgctgaca

SEQ ID NO: 415895 - DNA, 1184 bp, Homo sapiens
gaagagggtctgggcgatggtgcatccgggacgagcctccagagaccaagcgggataggtaaacccgccgcgcagctggcgggacgctgggccaacgaggtctggggtcttggcgcggagttcatgggccgccggccaggcttgtgccagtggctttggatccctggcctgcttcccccaacccagcctccagaccagcgctggcctgctccacacactccgcagcaccgtcccgggaaccgagcgtcggcggggaggccgcctctccgcaataccccatgtttccccatcactcgaggagtctgggcagagactggactacaccgtgggagaatctgcaaaggtgttgctggaacagacatatttctagttgtatgaggtggcctggacattactctcgagctccttacccatacttcagtagtaggcatttttcactaaattggagaccaccctgtttgtttgagtctagaactcagttccagtactgtaactggagacctgacaacctgagccagacatctttgattcatctctctagttacgtcatgaacgctgagggagatgagccttcatcaaaacgaagaaaacaccaaggtgtgataaagcggaattgggaatatatatgtagccatgataaagaaaaaacgaagatcctaggagacaaaaatgttgatcccaaatgtgaagacagtgagaacaagtttgacttttcagtgatgtcctataatatactttcacaagatttactggaagataactctcacctttatagacattgccggcggccagtattacactggagttttaggtttcccaatattctgaaagaaattaaacattttgatgcagacgtaagtgcaaaatattattgaaattcttcacataagaaaaagttggggccgggcacactggctcatgcttgtaatcccagcactttgggaggctgaggcaggtggatcacctgaggtcggtagtttgagaccagcctgaccaacatggagaaaccccgtctctactaaaaaatacaaaattagccgggcgtggtggctcatgcctgtaatcccagctactcaggaggctgaggcaggagaatcacttgaacctgggaggtcgatgttgcagtgagctgagattgcaccattgcaatccagcctgggcaacaagagcaaaactctgcctca

SEQ ID NO: 415896 - DNA, 782 bp, Homo sapiens
gattacttccgagctgtcctgcagcatgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccagttagtaatctccttcacttgctcattcgttacaaacatgtttgcatgcctaccatatctcaggcactggggatacagcagatcaagatcctaccccatggaactaaaagaggacagagtactgagtggaacataggatgatagatttacaaataatgtagcatacttctacttcattgtatcttaagtttcttgaaatattgctactggagattggaaagaaatcttaatgttatggggtattgtctaagaagctttattttaaaaccatctcattaaattttgttgcattttaaaaaa

SEQ ID NO: 415897 - DNA, 1352 bp, Homo sapiens
gattacttccgagctgtcctgcagcatgatgaaagaagtgaacgagcttttaagctaacccgggatgctattgagttaaatgcagccaattatacagtgtggcatttccggagagttcttttgaagtcacttcagaaggatctacatgaggaaatgaactacatcactgcaataattgaggagcagcccaaaaactatcaagtttggcatcataggcgagtattagtggaatggctaagagatccatctcaggagcttgaatttattgctgatattcttaatcaggatgcaaagaattatcatgcctggcagcatcgacaatgggttattcaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaaaaaaaaaaa

SEQ ID NO: 415898 - DNA, 1481 bp, Homo sapiens
ctccatgcctatcctagactatctttgaacaagttttatttttaaagaagcagcactttctagtttgttttatcatgcctttatcaagaactttttaagaatttagggacgcacacctcttatgctctgcccccatatttcatatgtagaaacataaacatcgaatttatatctatactgtggtcactccttctcttactagtgagtttggggtttttttccctccaaattttcttggatgtcttttttcctgctttctgtatgtgtctttccaggctctatcatcaatttcatacttgtatccccctctatttcctttacttgcagctatcactaccttctgaatttgtgataaatcctgtgtcctcagttctaccttctttgttgtagttttaatttattttttattcataaataatgggacatttctaattggatgatttttctaaatttttcctttaggaatttaaactttgggataatgagctgcagtatgtggaccaacttctgaaagaggatgtgagaaataactctgtctggaaccaaagatacttcgttatttctaacaccactggctacaatgatcgtgctgtattggagagagaagtccaatacactctggaaatgattaaactagtaccacataatgaaagtgcatggaactatttgaaagggattttgcaggatcgtggtctttccaaatatcctaatctgttaaatcaattacttgatttacaaccaagtcatagttccccctacctaattgcctttcttgtggatatctatgaagacatgctagaaaatcagtgtgacaataaggaagacattcttaataaagcattagagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaaaaaaaaaaa

SEQ ID NO: 415899 - DNA, 823 bp, Homo sapiens
gaatgtctcaagacacccctgttttaaagatggatactggtagtgaaaagagagacggaatgagttttgtgtattctgagtgatgaattttctgctaactggtttaaagttttagttccatttgagtcataggaaaagttcaaaaggaatttttgatatacccctgaagggtcaggaaatctaaactccaggccctgtcactaatgaattttctgtgaccttgaccaggtcatgtctctttttctggggctctgttttctctaaacacgatccagtctaggtttgtttttaagagtaatttcctctttctctccaaactatatatataaataagaaaaaagcaaatgtttctaatgttcattttccttttttggtgcttatgaagttctcaaacaattttgttttctggataatataagaaaaatgtccagagaaaacagagacactgggaaaagatagttgcagcaaagaagagcaaaagaaagcaagaaaaagaacgaagaaaagccaatcgtgcagaaaatccaggtgacaataaatgagactgttggtataataatatttattttttagcaaacgtgtctgcatgttccaatgagagtaggaattttgtataagtaaaaagcatctgggatgtgggacccactgccctattttcttgggaatcaaaacatcaaagaaagcaaaatttgtagctgggtgtggtggctcacacctgtaatcccagcactttgggaggctgaggtgggtggatttgcgaggtcaggagatcgagaccgtcctggataacacggtgaaaccccatctctactaaaaatacaaa

SEQ ID NO: 415900 - DNA, 691 bp, Homo sapiens
ctttttgcagttttcagagcccgcccttttatatttttgagacagggtctcctctgtcacccaggctggagtgcagtggtgcagtcacagctcattgcagccttgatatatgtcccaggctcaagtgatcatccaacctcagcctccagagtagctgggactacaggcacacaccagcacaccctgtcaattttttttttgttatttgtagagacaggatctccctatgttgctcaggctggtcttgaactcctgggctcaagcagtcctctggccttggcctcaaagtgttgtgtgaggcacttcacctggcccctttcttttaattgggctctctcttctcacaccctaatgccacttgttgcagtggtgcacctgtcttgaatcttgtctaccttttcctctaatttgatgctgccttttggcaatgagctggaagttccagatatccagaattgggtcttactgagttagggctcagaatgtgctctgattgattagactgcttgggccttttgatgcctactgtggctgcagatgtgcctcttttgcttatttccctcttggttctaagtggcagtgagtggaggactgtggatgagtgaccccccaaaaagtaagatattgtcacataagctcttgagacagttaactcattatctgcagtttcttccattccacaataggctac

SEQ ID NO: 415901 - DNA, 480 bp, Homo sapiens
aaagacaggctgaagtgcagtggcatgatcttggctctctgcaacctctgcctcctgggctcaagccatcctgccacctcactcctaagtattatagctgggactacaggcacatgccaccatgcctggctaatttttttgtatttttagtagagactgggtttcaccatgttgcccagtctggtctcgaactttggagctcaagtgatccttccaccttagcctcccaaagttctgggattacagacgtgagccaccccacccagccgtgagctgttttaacatcagactgtttgcattttccagttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaaggtaagtatacatttcagccccaacatc

SEQ ID NO: 415902 - DNA, 4659 bp, Homo sapiens
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415903 - DNA, 3593 bp, Homo sapiens
agcggagctgaacaggggcactgaggtgtcggccggcggggcagtggcccggagcggggggcgggggcgttgatcatgtttccctttgggccccatagccctggaggggacggatcggccggagccggggctgaggagccgacgccccacgaggggcaggcagcagccaccgggccgccctcgccactacatcccggggctgatgcgacccatccccctccacccgcccgaagccctcgccgccccggcgccccatcgctgtccccggccccgcgctccggagagctagggctgcctggagctccggagtcctcaactgcctccgccccgggagagccgtcacctccctcccctccgtgccggcggcccgggccagactgcagggccaagagccggggccgacacggcctcggcgcgggcctgggcggccctggcgctaggctgttcgggtggctgaaagagcgcacctgggccgcgggctgttcgtggacccggcgcgggacaattttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415904 - DNA, 4547 bp, Homo sapiens
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415905 - DNA, 4701 bp, Homo sapiens
gaatgtctcaagacacccctgttttaaagatggatactggtagtgaaaagagagacggaatgagttttgtgtattctgagtgatgaattttctgctaactggtttaaagttttagttccatttgagtcataggaaaagttcaaaaggaatttttgatatacccctgaagggtcaggaaatctaaactccaggccctgtcactaatgaattttctgtgaccttgaccaggtcatgtctctttttctggggctctgttttctctaaacacgatccagtctaggtttgtttttaagagtaatttcctctttctctccaaactatatatataaataagaaaaaagcaaatgtttctaatgttcattttccttttttggtgcttatgaagttctcaaacaattttgttttctggataatataagaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415906 - DNA, 4735 bp, Homo sapiens
ttaaggctgcttttcaaatataagctatctaactaacgtgtttataagctcagaataggagtgataccagcaacagctaatatttattcagtattctgtgttaggttcagttctaagaattttacatggattacctcaataaagaggagctgttattatcattcccattttgtaggtgaagagactgaggcttagagaaattaagtaacataattatgcccaagataatgtagccaatcaatgaacaaactgaacttggatttaaaccctgctgtgtgctgcagagcccatactcctcaccactctgtgtaaatcttctaatgaacgaataccttacatcagtatcaagtttctctttatatgcaaaatacccacctggctaagatttgtttcttatataatattcctctggttttccacttttatttctttctgatatttctgctttaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415907 - DNA, 4098 bp, Homo sapiens
gggggatccgagtgcgcgccgctgccgctgcgtgggggtgaggggatcaggaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415908 - DNA, 3975 bp, Homo sapiens
aatgcccagcttttaacctctcaccactgaattcctgtttgatcttcagggttcagttcaggagcatcttggcccttccccatcccaggccacagcagagcccttctgtttcccattttactgtgttcctttctgttgcaccctatccattcataggcctgtatctttcagggtaggctgaggtccttgagagcaagcagagcctgtgtccttgcctctccccgcaagaccttagtaccacatatggtgcagaataggtttgttgaacgaaatattacagaacatccttttcatttactcgttctttttttccctctgtggtcactgtgttttctgtttactctctaacagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415909 - DNA, 4770 bp, Homo sapiens
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415910 - DNA, 3395 bp, Homo sapiens
agcggagctgaacaggggcactgaggtgtcggccggcggggcagtggcccggagcggggggcgggggcgttgatcatgtttccctttgggccccatagccctggaggggacggatcggccggagccggggctgaggagccgacgccccacgaggggcaggcagcagccaccgggccgccctcgccactacatcccggggctgatgcgacccatccccctccacccgcccgaagccctcgccgccccggcgccccatcgctgtccccggccccgcgctccggagagctagggctgcctggagctccggagtcctcaactgcctccgccccgggagagccgtcacctccctcccctccgtgccggcggcccgggccagactgcagggccaagagccggggccgacacggcctcggcgcgggcctgggcggccctggcgctaggctgttcgggtggctgaaagagcgcacctgggccgcgggctgttcgtggacccggcgcgggacaattttcgcaccatgactagcctctacggttccatccaccccgcggactcggtgtacctcagcacccgcacccacggcgccgtcttcaacctcgagtactcgcccgacgggtcagtgctgacagttgcttgtgaacaaactgaagttctgctttttgaccctatatcttcaaagcacataaaaacactttctgaagctcatgaagactgtgtaaataatatcaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415911 - DNA, 3323 bp, Homo sapiens
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtata

SEQ ID NO: 415912 - DNA, 4572 bp, Homo sapiens
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415913 - DNA, 4723 bp, Homo sapiens
  misc_feature (2295)..(2295): n is a, c, g, or t
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgaacacacttgtnaccttagtacttggtcatccagcatcatacatgcatcacgtccttacagctgcacccaaaaggctgggccactcttcttcggtgctcaagcaacagtgatgatgaggagtgtacttgtgtctatgaattccaagaaggagctccagtgcgacctgtctcacctcgctgttctctacgactgactcattacattgaagaagccaatgtaggcaggggttacatcaaagaactttgcttcagccccgatggacgaatgatttcttccccacatggctatgggattcgcttgttgggatttgacaaacagtgcagtgaacttgttgactgcttgcccaaagaagccagtcccctgcgggtgatccgttctctgtactctcataatgatgtggtactgacaacaaagttctctccaacacattgtcagattgcctcagggtgccttagtggacgggtttctttgtatcagccaaagttttaggcacaacttacatcaaataaggaactcttctggtgtttgacttaggaattgcttcaatttagatgaagtattttctttttagaagatcttataagtttgggtcaagatcctggttcttatgggtccatgaacacacttgtgaccttagtacttggtcatccagcatcatacaggcatctccaagttagactctatgcagcatcatcttttgcagcattcctctgctcctgctgatctgtgccactgaactccagttcttctggtcattttgcatggtagctcttgtcacgttccttccttcctcactctctatttctctttccctctccctgtccctctctttctttgtgtttgttgattttggtgtcaattttgtggacatttggcaggagttttgactggggtaggagaaacccatgacattagaattgaataaaacctagaagttggatattggcatattggttgttgaaaaataaatttcatcctcacttatgagtatacttggccttttaaagttactgttatgtttatctatattgagcacagataatggcattattcttataattgttaagatagtcttgcaacaaaatgtcttttaagtttcctgttaaaattataaaaagattttcatggtgagagggattttattgtgaaattctagaaaaaaatattaccacctctctttgtaatttactttacttgtatgaatttaacatctctagcatgtatccttacttgatattttgttcctatcaacagcattagaaaggaaaggagacagaatgagctttggttatttctattgcacagaaaaggatttttaaaattagattagtataatatctggccatagagtgataagaacaatatgacttagattttctgtatttcatctgccagattatttgaatcacacaggatgatgtgttaacagtattagggtggaagaggaatcaagagtaaagaggtaggggtttactcatttttcttccctgagccaggtgtgacaagccaactctgtcaccattcgtgaggggagagttgcagtcctcttcaagctgttatcataagtacagtagtcagctacttggatatcaagactaagtgctgatatgaagacttgcctttgtgttttgttatgaaacacgcaagcataaagcaggactcaagcacaaggctgactgttctactttgaataacagcttccttgcagtctcctccacatgggtggtactgtgtttagaagggattaccaaaggctggagcgatttaagctatgcactagccttgccctcttaggttgcattctctttaggccactggttctcaaacattagggtgcactgtaaccattacagagcttgtgaaaagtgcagaaacctgagcctcaccttatgagattctgattcagccagggggaggacaggaatctgtatttttcatagcaacctcaagtaatctttattctgagggtctcgggattgcaggttgaaaaacacaaccttaatcagcagtaaattcttctctactcggccaggcgcagtggctcatgcctgtaatcccagcactttgggaggccgaggtgggtggatcacaaggtcaggagttcgagaccagcctgaccaacatggtgaaacgccatctctactaaaaatacaaaaattagccgggcgtggtggtgctcacctgtaatcccagctacccaggaggctgaggcaagagaatcacttgaacccgggaggcagagggtgcagtaagccgagattgcaccactgcactccagcctaggcgacagagcgagactctgtctcaaaaaaaaaaaaaaaaaaaaaaatgcagctgcaggagtgaggcgctgggaggtacctggacccaaagagcagggcagagggtggcagtggcacataggcaagtgtcttggcatgacatcttctcagagcttca

SEQ ID NO: 415914 - DNA, 2500 bp, Homo sapiens
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcagatttgaccacttcatcaagttcatctggtcctagagtttctggctcaccttgtcatcatagtgattctaattcttctgagaaacacatgtcacgagcctctcaaagagaaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggaggtacaggcagcagcactccaccttcaacagggctcattggacaaattgccattgccgtgtgtgcagagcttaggccgatcgctggctgcagtctctgccttcaagggcatactgctagagatcctgcttctcgactctcctgtttctggcctctcttgcttcatatgggatcattaccccttccaaactcttcttattcctctcctgctggggtgagcaaggtgggaggtactttaaggccagcatc

SEQ ID NO: 415915 - DNA, 2587 bp, Homo sapiens
gggggatccgagtgcgcgccgctgccgctgcgtgggggtgaggggatcagtctggtggaaaggacagaggactaagtccatggactggaaattggaagggagtactcagaaagtagagtcacctgtgctgcaggggcaagaaggcatcctagaggagacaggtgaagatggacttcctgaaggcttccagcttctgcagatcgatgcggaaggcgagtgccaggagggagagatcctggccacaggcagtacggcatggtgctcgaaaaatgtccagagaaaacagagacactgggaaaagatagttgcagcaaagaagagcaaaagaaagcaagaaaaagaacgaagaaaagccaatcgtgcagaaaatccaggcatttgcccccagcacagcaaacgtttcctgagagctctaaccaaagacaaacttttggaagccaaacactcaggaccaagactatgtatcgatttgagtatgacccactacatgtcaaagaaggtagaacatccactaagcctggaattcctgctcgccatgagggaggcccagaagggtacagctttccgaagaatatggtcaactccagcttctgggattccttagtaaactagaattaagtagactggctggacagattcgaaggttgtatggttcaaacaaaaaagctgacaggccattttggatctgcctcactggattcacaacagacagtcccctttatgaagagtgtgtgaggatgaatgatggattttctagttacctgttagacataacagaagaagactgctttagtttatttcccttggaaacccttgtgtacctgactcctgactcagaacacgctcttgaagatgttgatctaaacaaagtttacatcctcggtgggcttgtggatgaaagcattcagaagaaggtgacatttcaaaaggcccgggaatactctgtcaagaccgcacgcttgccaatccaggaatacatggtcagaaaccagaatgggaaaaactatcattcagagatactggccatcaatcaagtgtttgatatcctgtccacttacttagagactcacaactggcctgaagcattgaagaaaggagtttcttcaggaaaaggctatattcttcggaactcagtggaatgatgggcctaagattgcagctgcgtggccaggtgctcacgccgtaatgccaacactttggtagaccgaagtgggcagatcacctgaggtcaggagttcacgaccagcctggccaacatggtgaaacccttctctactgaaaatacaaaaattagccaggtgtggtggcgcatacctgtagtcccagctacttgggaggctgaggcaggagaatcacttgaactcgggaggcgaaggttgcagtgagccgagatttcaccagtgcactccagcctgggtgacagagcaagactccatctcgaaaaaaaaaaaaaaaaaaaagagtggcatgtcacctattgtgtgtggcctgcacgtaatgcactaattcttaatccctcgctgatcccagtgtaaagtggagacaccagtacatactcagcctcacaggactgactggtcaggccactcatccccaggcacgcggccaccggtcactgacaactacagaccgactctgccacccagatcaggtgcccagatgctcagtcgctcacacaggtcagtgctgacagttgcttgtgaacaaactgaagttctgctttttgaccctatatcttcaaagcacataaaaacactttctgaagctcatgaagactgtgtaaataatatcagatttcttgataaccggctgtttgctacctgctctgatgacactacaatagcactatgggatctgagaaaattgaacaccaaagtatgcactttacatggtcacactagctgggtgaagaacatcgaatatgatactaatacaagactcttagtaacatcaggatttgatggaaatgtcattatttgggacactaacaggtatacagaagatgggtgtccacataagaaattctttcacacacgttttctcatgcgaatgaggttaacaccagattgttccaaaatgttgatttcaacgtcctctggatatctcttaattttgcatgaccttgacttaactaagtctttagaagtaggcagctatcccattttaagagcaagaagaactacttcaagttcaggagtttcaccacgaaatagtcttgaagtcgtaacccctgaagttcttggtgagagtgaccacggaaactgcatcacgtccttacagctgcacccaaaaggctgggccactcttcttcggtgctcaagcaacagtgatgatgaggaggtacaggcagcagcactccaccttcaacagggctcattggacaaattgccattgccgtgtgtgcagagcttaggccgatcgctggctgcagtctctgccttcaagggcatactgctagagatcctgcttctcgactctcctgtttctggcctctcttgcttcatatgggatcattaccccttccaaactcttcttattcctctcctgctggggtgagcaaggtgggaggtactttaaggccagcatc

SEQ ID NO: 415916 - DNA, 446 bp, Homo sapiens
ctgtggatgagtgaccccccaaaaagtaagatattgtcacataagctcttgagacagttaactcattatctgcagtttcttccattccacaataggctacttatttttaatgctgtattacattgagaatatactcatgtataatttttataagaaaaatatttaactatatatttacagaaggtgacatttcaaaaggcccgggaatactctgtcaagaccgcacgcttgccaatccaggaatacatggtcagaaaccagaatgggaaaaactatcattcagagatactggccatcaatcaaggtacttcttacacggcccccatccagggtgtgtgagttctggtgctgctgctttgcactgtgtttaagtggcctttgagtcagtctcctctgtgactaatgtgtgtggactttattgcatgtacgtcatgacatatattctg

SEQ ID NO: 415917 - DNA, 336 bp, Homo sapiens
gcaggagtgaggcgcttggaggtaccttgacccaaagagcagggcagagggtggcagtggcacataggcaagtgtctttgcatgacatcttctcagagcttcacaataatgtcagggaccacatttaatgctttttaatctcccatagtgcctggctcacaggaagtgctcagatatgttaagtaataaaaagttaatgtggtgggtgcagtggctcacgcctgtaatcccagcactttgggaggctgaggtgagtggattacaaggtcaggagttccagaccagcctggctaatatggtgaaacctcgtctctactaaaaatacaaaaattagct

SEQ ID NO: 415918 - DNA, 1960 bp, Homo sapiens
gcattttattttatgagtcattttaaatgttaaatttagatacattcttcagtgacccataaatgtaacattatttttatattttcatgagttttgtaaccacttgccaaagctgcttcattagcatatgaataattacctttgtaaagaggaagttaaatagatagtgagatcctttctttataaaacttttaaatgttattgtgccaattcactaacatgaagttatttagttgcagggtatgtatgtatttttagtatttatgttgaaagaaagaagacttttaactagactttcaaactaggttaattgaagtatcacagtattcttacattttaatgccatagggttttttcccttaagatatccatgttacataccagttaaggacagataatctaatgcaaggtgtaaaaatgtaaaaattagtaatgtttaaagtactaattagcatatagcccatatgtatttgttggatgtgagtgtagcgtttgtaaacttttgaaagtagggctagaactctgctcatccctgtactctgcatagtacctagcacagacgtttgcacatagttaggtgctcaactgatacttataaaatttaattgaatttgacgcaagaatcatattaagtaaatgtttaaagtagcagcctagcaaatttttgggcatggtgtaagcactggtaaaaccagttaattttagagactatcaagttgttaaaaaatattaggacaccatcctttaattgttatcagcatcaataagacagttcagtttacaattttatacgatattgtggttaatttttattgccattatacatattactattcttatgaattgtttgagaagtaatcataatttatttacaaagataatttcttcaggttgtggtataaattattgagatatgtttgtaatttggatagtttgaatgctttaaaatacacttgatagagtttattaactttgtttattgctaaatgtattatgatatataaacaggcaattgaatttagctttttatctgctatgatctgaatgtttatatcccccacaaattcatatgttgaaatcctaaccctgaaggcgatggtcttcggaggtggggcctttgggaagtgattgggtcaagagggcaggcccttgtaaaagaggccccagagagcttgttcaccaattacaccatgtaaggacacataagaaggcaccatctacgaacaagaaggtgggccttcaccagacaccagagaccagaatctactggcatcttcatcttggactccccatcctccagaactgtaagaaataaatttctgtttttattaatgtaagctacccagtttgatattttattatagcaacccgaatggactacggtatgatcctttgaagaaacttacaaggtagtcagggcaggtaatgttattgtcattcttaacataagaaaaggaggctcagagggttaatgttctctgcatgattatagagctaaaaattggccaaaacagttcagaacgtgctgtcttctcttaatgtagagctatttgaactacttccagctgcagtttttatgttgtgttacctgtgtagagactgttaactgaagaagtacagatcacaagatttactatagaatttgaattttaaaaaatttctgatgttagcctgatttctccccagagacattttcatgtagtgatttaagaccagaggctctggattcagacttcttgagtttgaattctggctccatctggctttagggccttggacaagttacttttctattctttgttttgaaatctgtagaatgggtataagtgagattgaatgaatgcacacattttgtttttggagcagggctggatgtatagtaagctactgttactattattattacaattaccaacatttcctaaaagtgattagaataaagaacagtctttaggggctg

SEQ ID NO: 415919 - DNA, 266 bp, Homo sapiens
ttatttttcttttaatgttttgtaaccttacatgtgattaaagtgttgtccagactttttattttggaccagtctctcgtggaagttgcacaaatagcttggagggttcctgtgtatcttttgccagctctccccagtgatggtgtcttacataaccacagcacagtgatcagagccagaaaataacattggtgttattttttatttttttgacatggagtctcactccagcctaggcgacagagtaagactcctctgtctgaaga

SEQ ID NO: 415920 - DNA, 397 bp, Homo sapiens
  misc_feature (23)..(26): n is a, c, g, or t
ataccgatctacagaactaaaannnntttgaaaaccctttcacatcttgacgaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggtaagttaggccgaccactccagcatggtacaccggtgtgaagaacaataaagagactctcagcagatcaaaagt

SEQ ID NO: 415921 - DNA, 1811 bp, Homo sapiens
  misc_feature (23)..(26): n is a, c, g, or t
ataccgatctacagaactaaaannnntttgaaaaccctttcacatcttgacgaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaatccagctgtatttttttgcattcattcattttccattctgcaacctccatcacattagcagagtaaccagtaagttgttttctattttctaaagtatttttttctatcactatatgtatcacttctgagtcttacaggtatagagctgagtttagagagttgctaaaattcacctattggaccaaactaaggttggtacttggctgtttgttccccatctgagcctaagtctccagctcagacacatctctttatgggcacaactgggaacaacaaaatggcaacagttctacagctcataatataaccagtctgaagggttcccctactcacagaccccttcatttactgggagttaagcctcactgctaaataatatattttgaaactggaaaactgggcatgctgccttccacaatacaccactatactcatgattgcaggagggtggcttggggactaggggcaatgacacgggaaggatacaatcattgcccttacttatctttgatcttcttcccatcctcacactgaataatcacttgttcctaccttccctgtgaacctctcttgcctggctgcaaaattttaagacaccaaagacaaaattacattatgctctgagtgattacttacaagtacatcagaatatttacttacatagaaaagcactggaaaggaggaacacaaaatatgaaagacaattgatatggtactgaaatttttcttttttaactgttagatatttgtgcaataaataaaaaaggagggaaaaccatatcagagcaataggcaaggaggtggcaaactagataagtctccttggagaacaaaaaatatatttaaaatacaatagccctactacaactgatttatggctcaggtgactaaacacaatttgaagcagtaacaacactcataagctgaaaataaaatacttttagcccttttattcttcttgcctctttcccaaagaatatgccaatgaagctgttcttgatgtcacaatattcatatatcgcagaatttctgcatttaaactaccttgcctactgaaaataagataatcatttcatctctaggaaccagtaaccaaaaaaaaaatgtccttagagaatacatttttatttgtttgtttatttagagacggagtctcatttctgtctcccgaggccggagtgcagtgggcttgatctcgggctcactggaacctccacctcccaggtt

SEQ ID NO: 415922 - DNA, 2210 bp, Homo sapiens
atgctattgtgaggagtaaatgacttcagacactgaaggcttaacacagtgactggcatatcatagggatgcccaatacataccagctgtgaggcttatcaccactgttcttcctggcatggccctgtaagctcatcttcggctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcgaagtgtgtttctaaaaaatgctgggcacatggcgtagagtttgtagagaggaaagacttaattcacagcttcctctacatctactatgtacactggagtatctcaactgctgacctacccgtagcacgaatctctgctggtacctacttcaccatgaaggtctccaaaaccaaaccaccggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaatccagctgtatttttttgcattcattcattttccattctgcaacctccatcacattagcagagtaaccagtaagttgttttctattttctaaagtatttttttctatcactatatgtatcacttctgagtcttacaggtatagagctgagtttagagagttgctaaaattcacctattggaccaaactaaggttggtacttggctgtttgttccccatctgagcctaagtctccagctcagacacatctctttatgggcacaactgggaacaacaaaatggcaacagttctacagctcataatataaccagtctgaagggttcccctactcacagaccccttcatttactgggagttaagcctcactgctaaataatatattttgaaactggaaaactgggcatgctgccttccacaatacaccactatactcatgattgcaggagggtggcttggggactaggggcaatgacacgggaaggatacaatcattgcccttacttatctttgatcttcttcccatcctcacactgaataatcacttgttcctaccttccctgtgaacctctcttgcctggctgcaaaattttaagacaccaaagacaaaattacattatgctctgagtgattacttacaagtacatcagaatatttacttacatagaaaagcactggaaaggaggaacacaaaatatgaaagacaattgatatggtactgaaatttttcttttttaactgttagatatttgtgcaataaataaaaaaggagggaaaaccatatcagagcaataggcaaggaggtggcaaactagataagtctccttggagaacaaaaaatatatttaaaatacaatagccctactacaactgatttatggctcaggtgactaaacacaatttgaagcagtaacaacactcataagctgaaaataaaatacttttagcccttttattcttcttgcctctttcccaaagaatatgccaatgaagctgttcttgatgtcacaatattcatatatcgcagaatttctgcatttaaactaccttgcctactgaaaataagataatcatttcatctctaggaaccagtaaccaaaaaaaaaatgtccttagagaatacatttttatttgtttgtttatttagagacggagtctcatttctgtctcccgaggccggagtgcagtgggcttgatctcgggctcactggaacctccacctcccaggtt

SEQ ID NO: 415923 - DNA, 1667 bp, Homo sapiens
caaatttttttttttgagacagagtttcactcttattgcccaggctggagttgcagtgagctgagattgcaccactgcacttacacctgggagacagagcaagaagactccatcttgaaaaaaacaaaaagagttggtatgactggtctgggctaacagttgtccttctcttttttaggatgcacccattgttgtttcttatgtaggtgaccaccaagcattagttcacagaccaggaatggttcgctttcgagaaaactggcagaagaatcttactgatgccaaatatagtttcatggagtcattccccttcttattcaatcgtgtctgatacttacaggatgtcttaggattgtttttctcatcaggatacattaaaaatacaatacagcacgtcaaaccacagaatatttattgagtaataaacttgtggcacacaatccagctgtatttttttgcattcattcattttccattctgcaacctccatcacattagcagagtaaccagtaagttgttttctattttctaaagtatttttttctatcactatatgtatcacttctgagtcttacaggtatagagctgagtttagagagttgctaaaattcacctattggaccaaactaaggttggtacttggctgtttgttccccatctgagcctaagtctccagctcagacacatctctttatgggcacaactgggaacaacaaaatggcaacagttctacagctcataatataaccagtctgaagggttcccctactcacagaccccttcatttactgggagttaagcctcactgctaaataatatattttgaaactggaaaactgggcatgctgccttccacaatacaccactatactcatgattgcaggagggtggcttggggactaggggcaatgacacgggaaggatacaatcattgcccttacttatctttgatcttcttcccatcctcacactgaataatcacttgttcctaccttccctgtgaacctctcttgcctggctgcaaaattttaagacaccaaagacaaaattacattatgctctgagtgattacttacaagtacatcagaatatttacttacatagaaaagcactggaaaggaggaacacaaaatatgaaagacaattgatatggtactgaaatttttcttttttaactgttagatatttgtgcaataaataaaaaaggagggaaaaccatatcagagcaataggcaaggaggtggcaaactagataagtctccttggagaacaaaaaatatatttaaaatacaatagccctactacaactgatttatggctcaggtgactaaacacaatttgaagcagtaacaacactcataagctgaaaataaaatacttttagcccttttattcttcttgcctctttcccaaagaatatgccaatgaagctgttcttgatgtcacaatattcatatatcgcagaatttctgcatttaaactaccttgcctactgaaaataagataatcatttcatctctaggaaccagtaaccaaaaaaaaaatgtccttagagaatacatttttatttgtttgtttatttagagacggagtctcatttctgtctcccgaggccggagtgcagtgggcttgatctcgggctcactggaacctccacctcccaggtt

SEQ ID NO: 415924 - DNA, 616 bp, Homo sapiens
atgctattgtgaggagtaaatgacttcagacactgaaggcttaacacagtgactggcatatcatagggatgcccaatacataccagctgtgaggcttatcaccactgttcttcctggcatggccctgtaagctcatcttcggctgaagagaagctagcacttgcaaacattccatctggcaatctgagagaagctactgagagaatcctgagacatccccagccacctaccactgctcctgttccaagcaaagaagatctgctcactccggaaaaagaaaatgagtgagactcaaaattcaacaagccagaaagcaatggatgaggataacaaagccgcaagccaaacaatgccgaatacacaagacaagaactacgaggatgaattgactcaagtagctctagctctggttgaggatgtcatcaattatgctgttaagattgtggaagaggagcgaaaccctttgaaaaacatcaagtggatgactcacggtgaattcactgtggaaaagggtcttaaacaaattgacgaatatttttcggtaagttaggccgaccactccagcatggtacaccggtgtgaagaacaataaagagactctcagcagatcaaaagt

SEQ ID NO: 415925 - DNA, 617 bp, Homo sapiens
gccatcctgagtaaaatttgggtcctgtttctaaaagggaccaatggattttggctgggtcactggtggtctctgccctgtaggagatgtgagtttttagtttaaaaagattattttcaagttgtcaagctctttgccaggggagattccttctggcagcacatcgaaacactggttccctcagcccatgccaatcaagtaccatggaccccttatccctgggggtatattccaagacccccagtggatgcctgaagctggggatagtactgaaccctgtatagcatatactatgcttcttcctatacacacacatctatgataaagttaatttataaattaggcatagccacaattaacaataactaagaatagggtaattataacaaatactataataaaagttatgtgaacatggtctctccctcaaaatatcttattgtactgtactgagggtaagaaatggcagaaatcaaaaccatggataaggagggatgactgagattgcagaatcaaatccctcctggcctcagagcttatgatcacaggttcaaagctgtgtgatgtcaaacagccctgtgggaaaacatctcaccttgtcaactaaagaaaaaaaa

SEQ ID NO: 415926 - DNA, 2508 bp, Homo sapiens
cagcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttgcttggcgaaaacactacaaaggctgggaatgtatgtttttataatttgtttatttaaatatgaaaaataaaatgttaaacttt

SEQ ID NO: 415927 - DNA, 578 bp, Homo sapiens
ctgagatgacagtcggctaactaccatcaggttacaactttacaaagaagtgaagcagcaaaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttgcttggcgaaaacactacaaaggctgggaatgtatgtttttataatttgtttatttaaatatgaaaaataaaatgttaaacttt

SEQ ID NO: 415928 - DNA, 473 bp, Homo sapiens
atttttttttcataatgagtttattttccataatttatagcataggtaacagaatcattttgcaaagacacggactagagaagaataaaagaggcaattatgatcattagaggtggcttcggaggaccacgagacagcactatggacaaacaaaatgcactacacaacatactcctcctggggggcagtcaaaacacagaaatgtagatcgctcagtcactgaaacggattgacttggctgttctaacttccacaccgaaaggaagacagggtggtgatggggggagagtgattactcctcaaacagagagtgatttaacaccaccactggctatgtgacagataaactaatttgcccaaatcactaagcttggggtttttccacccacattaatttggttgcttgcacatgacaacagcatcatttattggtgacaggattcaaagacctgggcattgcagctagcaggaga

SEQ ID NO: 415929 - DNA, 2365 bp, Homo sapiens
  misc_feature (13)..(13): n is a, c, g, or t
  misc_feature (16)..(16): n is a, c, g, or t
  misc_feature (24)..(24): n is a, c, g, or t
tcatgctggtacnccncgcagtantcggatatcgtcgaccaggcctgcgcagcatcacgaggctgacgctgtttgaagagtttgagaagcaacgggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggccccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctattta

SEQ ID NO: 415930 - DNA, 2773 bp, Homo sapiens
ggcttcttcagcaaccgcagcctcgccctcgtcatgagccaggcccgcttcgagaagatcctcaagtacttccacgtcgtggccttccgctccagccagaccacgcacgggctctacaaggtccagcccttcctcgactccctgcagaacagcttcgactctgccttcaggccttcccaaacccaggtgctacatgaacccctgatcgatgaggatcctgtattcattgccacgtgcacagagcgggagctgcgaaagaggaaaaagcggaaattcagcctctgggtcagacaatgttcttccactggcttcatcatccagatttatgtccacctgaaggaaggtgggggcccagatggcctggatgcgctgaagaataagccccagctccacagcatggtggccaggagcctgtgccggaacgcggcaggcaagaactacatcattttcacggggcccagcatcaccagcctgacgctgtttgaagagtttgagaagcaagggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggccccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctattta

SEQ ID NO: 415931 - DNA, 2204 bp, Homo sapiens
ccggccgccgtgttgaacaccctccgcgcaccgcgaggcacagtacatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggccccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctattta

SEQ ID NO: 415932 - DNA, 2013 bp, Homo sapiens
  misc_feature (13)..(13): n is a, c, g, or t
  misc_feature (16)..(16): n is a, c, g, or t
  misc_feature (24)..(24): n is a, c, g, or t
tcatgctggtacnccncgcagtantcggatatcgtcgaccaggcctgcgcagcatcacgaggctgacgctgtttgaagagtttgagaagcaacgggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggct

SEQ ID NO: 415933 - DNA, 3142 bp, Homo sapiens
  misc_feature (13)..(13): n is a, c, g, or t
  misc_feature (16)..(16): n is a, c, g, or t
  misc_feature (24)..(24): n is a, c, g, or t
tcatgctggtacnccncgcagtantcggatatcgtcgaccaggcctgcgcagcatcacgaggctgacgctgtttgaagagtttgagaagcaacgggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggccccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctatttaaaaaaaaaaaaaaaaaaaaaaaaaaaaaaaaaaaaaaaaaaaaaaaagagagaagaagaacaagaaaaaaaaaagaaaaaaagagaaagagaaaaagaggagagaagaaaaaaaaaagagagaggagagggagagagaaaaaaaacagcacgaagaataagagggagggggaagaggacaggaaatgacgggaagaaaaaatagtcaaggctaaggtagaagtaatcgttattaggcttcaagagattgaaaataactaaaggtacaaagaaataaatatgatactgagtgtaggttaaacatctagtaagagtagtatgtgaggacaagagtacaaaaaaaatatactaagagtaagaatacaggtataggctcatgtctggtctatgattagtgttaatatatatattgtacaatgatcaggaagtttgaactagaagaattagtaaagaagatagaaaactatgaagaaaagcgacagaaaatcaagaaagaaaaggaaggagaagaagaaagaggagaagagaaggaaaagaagaagagacagaaaacgctaaagaggcaagagagggcaagaagagcgtcaaacagaaacaaggaaagagaagcaaaggaagaaagtagaagagaaaagagccaaaggaacaagaaaaggaagcaggaagcagacacgcgacgcaggaaagcgagcaagcgagagccgagaagcgaacagagaagcaggcgagcaaagacgagggagaactaacagacagcaagacgaacaaagggcgagag

SEQ ID NO: 415934 - DNA, 2370 bp, Homo sapiens
  misc_feature (13)..(13): n is a, c, g, or t
  misc_feature (16)..(16): n is a, c, g, or t
  misc_feature (24)..(24): n is a, c, g, or t
tcatgctggtacnccncgcagtantcggatatcgtcgaccaggcctgcgcagcatcacgaggctgacgctgtttgaagagtttgagaagcaacgggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttacaatggctcaggtgtcaggggaggccggagggttttccagcatttgcctcatgccagcacctttgaaccggtctcttagaagaagacacacatcctgggtgtacagtggtgaaatggggagtgggtgcccattctgaaaaacgaggcattcctgctcattccctctgcttagctggtgggcaggggagagagggaaatgccaaaaacttggagtgaaggatgatgctattttttatttttaaatatatcttcaggttattttcttactgttgcttcagatctaatgtaaaaggcagatgtcccctcctctccacccccgacgctgaccccggcctcagtcacggctctttgcatgatcacagttctgtgttctggcctgtggcagggccgggaagggccgctggcttccgaacagacgtggttgctctccacgaggcgcatggggagcccgcgggccctaagctttgtcgcagatgtcatcattggcagaattacttgtcttgaaaaataagtagcattgctgaaacacacaaccgaattctctacgatggccatttgctcattgtctttcctctgtgtgtagtgagtgaccctggcagtgtttgcctgctcagagtggcccctcagaacaacagggctggccttggaaaaaccccaaaacaggactgtggtgacaactctggtcaggtgtgatttgacatgagggccggaggcggttgctgacggcaggactggagaggctgcgtgcccggcactggcagcgaggctcgtgtgtcccccaggcagatctgggcactttcccaacccaggtttatgcgtctccagggaagcctcggtgccagagtggtgggcagatctgaccatccccacagaccagaaacaaggaatttctgggattacccagtcccccttcaacccagttgatgtaaccacctcattttttacaaatacagaatctattctactcaggctatgggcctcgtcctcactcagttattgcgagtgttgctgtccgcatgctccgggcccttcgctggctcctgcatacagatcacggtcaacagttcggcgcgtgggtggatataataccgcggactgcagttcaagctacaggttgtgttcccatacacccaggtagagcccgtctacggcagttcacgcacccataacacaggtagtcgtgtggttagatcttgtgacagcctgtgacatagaccggcatttattcgtcaagtgtgttcccaacccttcagtacgctacaatcatagagaacagagtttggtaggtgagccgacacctgacagcatttttagagcatgaacacaggt

SEQ ID NO: 415935 - DNA, 1286 bp, Homo sapiens
  misc_feature (13)..(13): n is a, c, g, or t
  misc_feature (16)..(16): n is a, c, g, or t
  misc_feature (24)..(24): n is a, c, g, or t
tcatgctggtacnccncgcagtantcggatatcgtcgaccaggcctgcgcagcatcacgaggctgacgctgtttgaagagtttgagaagcaacgggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgttctcaagggcagattctctcatgacatccgtggagcttgcgaggcagcgtggactggtgactgtgaaggaaggcccccgtggtagaatgagctggagcacgctctaagagagatgcctgcttcctaaagatctacagcaatctgggacgtggttcaagttcaagacttgaaggaagcaaagacgccctgcatggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctattta

SEQ ID NO: 415936 - DNA, 1542 bp, Homo sapiens
ggcttcttcagcaaccgcagcctcgccctcgtcatgagccaggcccgcttcgagaagatcctcaagtacttccacgtcgtggccttccgctccagccagaccacgcacgggctctacaaggtccagcccttcctcgactccctgcagaacagcttcgactctgccttcaggccttcccaaacccaggtgctacatgaacccctgatcgatgaggatcctgtattcattgccacgtgcacagagcgggagctgcgaaagaggaaaaagcggaaattcagcctctgggtcagacaatgttcttccactggcttcatcatccagatttatgtccacctgaaggaaggtgggggcccagatggcctggatgcgctgaagaataagccccagctccacagcatggtggccaggagcctgtgccggaacgcggcaggcaagaactacatcattttcacggggcccagcatcaccagcctgacgctgtttgaagagtttgagaagcaagggatttactgctgcggcttgctccgcgcgcggaagagtgactgcaccggcctcccactgtccatgctgaccaacccagccacacccccggcccggggccagtaccaaatcaagatgaaggggaacatgtccttgatctgctggtacaacaaaggacacttccgcttcctgaccaacgcctactccccggtgcagcagggagtcatcatcaaaaggaagagtggggagatcccatgccccttggccgtggaggcgtttgccgctcacctgagctacatctgcagatacgatgacaaatacagcaagtatttcatttctcataaaccaaacaagacctggcagcaggtgttctggttcgccatcagcatcgccatcaacaatgcctacatcctgtacaaaatgtcagacgcctaccacgtgaagaggtacagccgggcgcagtttggagagagactcgtcagagagctgctgggcttggaggatgcctctccgacccactgatgctgggggcgcaggactcggtcaagggaggggcaagaggaggaggagagcctgccgttccaacttgcccatcagagacccggacacggcctggtgtgtggcttgctgcctgggagggatgcacagggcctctggagggacaggatggacctggtcagaggacggttgctgtcctcatttgcattccaagaagagcatgtcctccctcgagaaacagtgccgccggtgtgatgagcacttacacccacgtggctcctgtgctctagatcatggtgactcccccgccctgtggttggaatcgatgccacggattgcaggccaaatttcagatcgtgtttccaaacacccttgctgtgccctttaatgggattgaaagcacttttaccacatggagaaatatatttttaatttgtgatgcttttctacaaggtccactatttctgagtttaatgtgtttccaacacttaaggagactctaatgaaagctgatgaattttcttttctgtccaaacaagtaaaataaaaataaaagtctattta

SEQ ID NO: 415937 - DNA, 466 bp, Homo sapiens
ttgcttttgatctactactttttgagctcccccaaagcaatcatattaagctgtgctgtgtgtgatgccttgagtctctcagctgctgtagccaaccaggtgccgcctgccacttgataattggtccactgtctgcacatggggcttgacagatccagcctcataatacggtagcacttaatttcaatgaaaaaacaaactggcagccagtttagacatgcaagggctggtctctctttggtagcagctgcttgatagagcctgtcaggaggtagatggcattggcatttgggagtgaagtcaccttctggagaagtggctgtgttttctccatatgaggccatgaaatactggcatgtagaaatggtttacagaaactactttatctttatgcatatgatatttgtgatataggaaacatttattttaccttcattggaaaaggaaaataaagtaaaagaaaaaa

SEQ ID NO: 415938 - DNA, 678 bp, Homo sapiens
agatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagccgagttgatgaccccccgggtggatgcagatgacattgtagagaaaatattacaaagtcaagacttcagccctagattcccagtgcggaagaagaaggactaaggctatttgtgggtcctgggggaagtacaacctttggcagtcatcatcttccaaatagggtggggtctggagcttatgaacaagttgtgatcaaacgctagaagtcaagtcggtgaaaacatttccttgtggatttaagatgtgagtagttgatgtatcaaggcattttattcaagcacttaatagaaaatgaacctcaactatcaagaggaaagccaatgctggtttcttctctggaaggaccca

SEQ ID NO: 415939 - DNA, 670 bp, Homo sapiens
agatctttcagcaaagagtgcctctgttccagacgaacttggtgcctgtggacattctagaacatcaagctatgcaagtcagcagtcaaaagtatcagggtatagcacgtgtcactcccggtcatctagtttctctgagctctgccacaggagaaatacctcagtgggaagcacatcaacaggagttgaaagtattctagagccatgtgatgaaattgagcagaaaatcgctgagccaaatcttgatacagctgataaagaagatacagcttcagaaaaactcagcagatgcccagtgaaacaagattctgtagaatctcagctgaagccgagttgatgaccccccgggtggatgcagatgacattgtagagaaaatattacaaagtcaagacttcagccctagattcccagtgcggaaggtgtgtaggtaactgttaagcatagattcctgcaatcccaggtttttgtaatctgtgtagtcagcagtaaagaggctcagaacatcataatactgactgttgcatatttgtatagtaaatttcatgcccataaaaatatcaagataactttatagctcatttattaatgagaatgagtattgagtttagaaaaagaacaaatgttagttaaaagtgatcaattttaaataaaacatttattgtgttttta

SEQ ID NO: 415940 - DNA, 393 bp, Homo sapiens
gtcaaactccgtatttgctggaaattaaccaacatgaaatgcatgattttcccctaagaaattttgtccttttaaaaaaaaaaatttcctgcagagctggttcctacccataacagcagctgtggattatttaggactcatcccttttttcttgtcattcactgttccatgagcactactatttattaggtggagaatcgcctgattttctgaagtttggaagagaggacgcctaatgcaaatttggcctggttatagaacattcactttttggtattctcatcgttgttaacatgaatggttgactgaatgtagagctggctgtgttgttctgcacactgactggaatttgtagagttcaggtagttctaaaataaatggtttcactcagca

SEQ ID NO: 415941 - DNA, 815 bp, Homo sapiens
caattcagctcttcttttggaatgaaagtatagccaaaacaaacaaacaaaaaaatcctcagtatagcttgcaattaagacttagatcacagtatttaagtgttttgagttttgtacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatcca

SEQ ID NO: 415942 - DNA, 1108 bp, Homo sapiens
  misc_feature (777)..(777): n is a, c, g, or t
  misc_feature (807)..(807): n is a, c, g, or t
caattcagctcttcttttggaatgaaagtatagccaaaacaaacaaacaaaaaaatcctcagtatagcttgcaattaagacttagatcacagtatttaagtgttttgagttttgtacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccataagatccaaaaaaaaaaaaaaaaaaaaaaaaanaaaaaaaaaaaaaaaaaaaaaaaaaaaaanaaaaaagaaaaaaaaaaaaaaaaaaaaaaaaaaaaaaaacaaagagagagagggcgggagcggacggacagacgaaaaaacaagaaaaaaaaaacacatagggagaagagcacacaacaaaagaagaacagcaaggcacaagcgagggtgccaaacaagaaaacaaggggaaaaaaaaaaccagaagaagccacagcacaaaaaacaagacacgggcagaaacaccaggcgaccaaacaaccaaacggaacgaagagaaagacaaggagaaaacaagagacacaacgcagcacaaaaaaac

SEQ ID NO: 415943 - DNA, 866 bp, Homo sapiens
caattcagctcttcttttggaatgaaagtatagccaaaacaaacaaacaaaaaaatcctcagtatagcttgcaattaagacttagatcacagtatttaagtgttttgagttttgtacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccaaggatgcggccggttttttttcttcccacctaaaaatatatctcatcgcac

SEQ ID NO: 415944 - DNA, 777 bp, Homo sapiens
caattcagctcttcttttggaatgaaagtatagccaaaacaaacaaacaaaaaaatcctcagtatagcttgcaattaagacttagatcacagtatttaagtgttttgagttttgtacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggacaccggaaataagggggtaccgagctcg

SEQ ID NO: 415945 - DNA, 1464 bp, Homo sapiens
tgaaaatctggatttattttaaaaagatatcttgccatgaaggtatttgttttatagaaatatttacctccagatttctttctctaataagatggtgaatttaaaacactgtgttatttagaaacactgcatttacacttcatttattgtataaagcaaattgcattgaatcttcgccacttgacccaaaggccaaaaattggcatgagaacaatttggactacacatcaccaaacccggggttcacacctgtccactagcagttccagtgccttcccctagccctggatttggcaaagcacagaatgttaagagctaaaagttattgtagaggctactcagtcccacccgggaaactgaggatgaatgagggtaagcggttgcccagagcccgttaacccctccgtggctggggccctgcctagaacccgaatttcctgactaccctgtccaaggtattcatgtcacatcacactgaaacgctaaacctagagataggagaggccctctgggataaatccctgttccaccaaagaccagccagtcatcaaagatgagagaaggcatccctgtactgtaacaaaaagctggctttaggcgtggcttgtagaatcaatctaactactagacaagttacatctcatatatgtgtggcttctttttcttcttttggggggctacaaggaaggtttggagaaattatttccatcatacctttttgttagcctttttccatttctggccagtaagtaatcccgttcctgacaacagtccctttgttttctcaagtggtctgatgaaggactgcaaaccacagctcttgtgttttttgcaccatgggttttaaaatccgtcctctgcctcccacaaggagctactacccaagggaagggagaagattaattggtgacctttcgccgtgttaaaataggatgagtatgttgctggtcaaggcagaaacgctaacttccaactgtggtctgttaagagatctgctgggaaccttcagaagcactgccttccaaggcggggccacagcttggggtgttcagcacttgaggacgggtggagcttgttcaacccaaagatgtgtgcgatgaacggatctacacactggaaatacgtatcaaaactgcaacagcaaaatcatattttgtaaattaaaattgtgtttacttactgtgactactgttcagtctttattcagaaacctttttataggctttcttagcaaaaaaaaaatccatatctatggataatgtctcaatcttctgtatatatgttttattaatatgtaaatatttagattttttaaaattactatgttctttaaaaaagaattcaatgcaagcctggttgtgaaaatggtgtataacattgtgttgtggtatcaattcccaagatgctctttatgtctgatctggaagaatacaataaattactttaattgaacgtgaaaaaaaa

SEQ ID NO: 415946 - DNA, 3943 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415947 - DNA, 4384 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaatgtatgttggaaaaaaatgggcaagagaaaattaaggctttcttactctagatttattcttatttcttgacaaaatgattatttgcttggaaggtgtgatggcatacggtttaaagactctattgctttatgggatgtgactgaatagcagtgttgtgtaggcataaacttaagttttcttaatttgagttgaataaggaatatactatttcaggaagggtagggatactaaatatgattctgaaggtttcaattcttctctggggtaagatccaatgaatggaattgtggttagtattttggtaagcttcttttataaattgaacttcaatgtttctacccagcgtagtaagctagttaaatgtgttttagtgttacctcatttggggaaatttaaaaaagaagtatgggggacgactattgacagtattctcatttttagtaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415948 - DNA, 3787 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415949 - DNA, 3893 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415950 - DNA, 4419 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagagaaattgtattagttgtatgtttcttgtttttgtttttaactactccctttggaataccagtttgacttgtaagtggtggtttctaaataaatacctggccagaggaccatcacctgtcaccttattaaaacagtatttttaaataggttctttttgttgtcttagatgtgatcaaattatttcaaggaaaatgaaaataattctacttaccctcactttttaaagtgaagagtttagaacttaagaatatattttcaaatgtgaataaaacttcatatccaggaaaggatgctattttaagtatcatatactttaagagtatctagcaagcgctgtgtgcttctctgtcttgtcttgtttattcctcagtaaattacaatggtggtaccaaaaacaagactatactgcatagttggatagaaaaccagaaagtgtcaacttgctacagtcattaaaagttttattattggctgata

SEQ ID NO: 415951 - DNA, 3826 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415952 - DNA, 3763 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattgtaactttttgaattttgtgcgttttccccgctacagcctctagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415953 - DNA, 3923 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggatattttgctcatcaacctcattatagaacatatgatttgtgatacagatcctgaacttggaggagcagtccagcttatgggcctgcttcgaactttagttgacccagagaacatgctagccactgccaattgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415954 - DNA, 3704 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctaaaaaaaaaaaaaaaagaaaaaaaaaagagaaaaaaaaaaaaaaaataaagggacggccggtcataaaaagaaaattcgcaccagggtgtgcccaaacgaaaacggcaaggagcccagaaataatggaaaacaccggggggcggcacaacataaggcggccgtaaaccgacatagagagggaaagtcgcgcggggcgcacaaaaaagcggacgacacatgagaaaacacgagcaaaggggagggcacatctgaagcagcgcacccaagtcgaaggggcgacaacaat

SEQ ID NO: 415955 - DNA, 3676 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataactaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatactcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415956 - DNA, 3825 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattataaaccgtgtcagcatggttgcctggctacctgctcatgaaggacttgattaatagcaaattggcaatttaacgagccacttccatgatctccaaagaaaccaaaatacaaacacaatatttaatcttgccaaccgaagacgatgtgactgcatgaagtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgatattatggatccaataagtaaattcatggaaaggaagaaattaaaagaaagtgaggaaaaggaagtgcttctgaaaacaaacctttctggacggcagagcccaagtttcaagctttccctgtccagtggaacgaagactaacctcaccagccagtcatctacaacaaatctgcctggttctccgggatcacctggatccccaggatctccaggctctcctggatccgtacctaaaaatacatctcagacggcagctattactacaaagggaggcctcgtgggtctggtagattatcctgatgatgatgaagatgatgatgaggatgaagataaggaagatacgttaccattgtcaaagaaagcaaaatttgattcataataatggcaacggcctaggatcagtacctgttgaaaaaaactggttctccacccctcccccatacaaaatccacaacaaagcgcagtggtctcttgtgaatgactgacacagatcagcctcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcatataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415957 - DNA, 3412 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggaagatataaaatcattaactgctcatgtaattgaaaattactggaaagcactggaagatgtagattatgtacagacatttaaaggattaaaactgagatttgaacaacaaagagaaaggcaagataatcccaaacttgacagtatgcgttccattttgaggaatcacagatatcgaagagatgccagaacactagaagatgaagaagagatgtggtttaacacagatgaagatgacatggaagatggagaagctgtagtgtctccatctgacaaaactaaaaatgatgatgaggatgaagataaggaagatacgttaccattgtcaaagaaagcaaaatttgattcataataatggcaacggcctaggatcagtacctgttgaaaaaaactggttctccacccctcccccatactcttacacttgacttctgctcatcaagtgccaattcaatggagcaggaggaggggatatcatatatttaggggaaagacttaagcctttgagctctccagcttggaccacacattgcccttttctcagggaaggaaatggaaacaaaaagccaacagggcaggggttttgtaagtggaactctggattgactggtcagttgctacaatcagaatatgctttcttggaccatgtttgagactcagaagaatgggcctttctgccataattcttcactagtcaagaatgccagcagtttctttgtataaagagacctgcctttaaaatcatacattctgaacattttagtcaagctacaacaggtttggaaaacctctgtgggggaggggcgagtataaagttttcctcttttttaactgttccctttgcccttcaaactgcagatatttttttttttaagtggggacttctccctacttgattaaagattgagtggaattctagatgtggtcatttgtgtcataatttttttgttttattttgtttttgattttttttttcctcccctgagtgtatgcttagttgttgagtatatatatttgggaccattaaaactttttttgatgtaatataacctaacgttgtgctggtacctgttttaccatgtgtaatttttgttctacatcacagttcttaatttgtttagagttttatgaaagatggtatagtttttattgacaaaagcaaagtaatcttacaactatgtgcatacaaaagcaatactattttgtgactaaatattttatattaaaatttacatcagcaactgtcttgagaattcagggaaatagaatggaatttaaaacttcaacagttttgttaaatctagaaacatgaaattagtattccaaagagattctgaaatttcttttcttggggaaatgacggtacattaaatcaaaattgaggatggatgatttaaaaacatttgactttttaataataaaaagaaaagtgaagagtaagag

SEQ ID NO: 415958 - DNA, 3870 bp, Homo sapiens
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattggttaactttttaaaagaattttgtgcgttttcccaaacgctacagcctcaaaacagagatgcttttttcaagactttgtcaaacatgggcatattaccagctttagaagtcatccttggcatggatgatacacaggtgcgaagtgctgctactgatatattctcatacttggttgaatataatccatccatggtacgagagtttgtcatgcaggaggcacaacagaatgatgatgtaagtaagaagttaacagagcaaaaaataaccagcaaggtaaatattatttgtactaatagtaagtatttatacataggaagctataactgtttttattattcacttttaagatttaattgttgctgtttgggaaaagtgtagccataatatcagacagcttattgttcccctaaattggttcctgtctcagtttatcaatttgtcctacagcaactatttatgttcatttaaattgccttttaaaatattcatgtcagtttttttttgttttgttttgttttaattctgaagtcaacttgctatattgtgttttttaaatcatttagtcaatcaattcttgtatctggggaattaagagtaagttacctaggaaaacattgactttagggtagattctcaaaatcgccaagaatgaagaaatgtagcacagtcccttaaaatatgaagggtgctgtttctttactgcctagccatagagaacaagctgttacgttgttcacaaacactcacgttagcatctgagatataccagattttaaagtagtagagaatatatcctggtaatgtgaagggtgcgcctggatcacatagtgcgtgacatgtgagagcactaaatgtgtgtgctctcctttattttaaaataattgaaccaatgattctgattttttcctgcttcccccataacaatttggaagcaactttttacgtaagaatgagtaagaaggacctgctctcaggtccttcttaagggaggaggggaataaagatcccctaaggaaaaaaaaaaaatctgtttagaattccagcctgtggtatttttacgaaataggaaaatagactgtcttactttttgaaaagatcctatttaatgtattgtgatgtcaaaaggaaatggaatgccatgtaactgctatgtttaagtttttatttttatagtgcaggataggtgcaaaaaagcaccagtttgaactgttgtgtcatgtttttcttttataaaatattaacatcggcctcagcaacatagcaagaccctcctttagtacaaaattaatttttaaaacttagatatggtggcatgcacccatagtcccagatactcaggaggatgagaaggaagagtctcttaagaccaggagtttgactctgcagtgagctatgattgctccactgcactccagtctgggtgacgaagccagaccccatctcaaaaaaaaaaaaattctttgagaaccaaagtatctgtattattgaaaataaaggctattgttggtcccattaacccatgagctgaacatatgaacatgtattgatatacctcaaaatacacacagtaggactctttttttttcctgttttgcaacagaataacatttcagtcactaggactcttgattcccactcttcttaatcatcatttccatctactgtctgcattttctctatcccttgtccatcctgcctttgcatacacataggcaagagcagggattttctcactgaatccctctcaatcttatttactacttaggtgaggaataccagtcataataggacctcaggaaaaccagccatctcttttctttgatatttagaatgtgtataatccatttgttctctgcactctctaaataccatagtctcattttctccaatttcagacattcagataattttttcctaaatttattttaaaaggaaattttatatcacttttacaaatggagaacatacatcactggccataaatagaaggactctataataataaaagcaatagaccaggcacggtggctcacgcctgtaatcccagcactttgggaggctgaggcaggcggatcacctgaggtagggagttcaagactagcctgacgatcatggagaaaccccgtctctactaaaaatacaaaattagccgggcatggtggtgcatgcctgtaatcccagctactagggaggctgaggcaggagaatcgcttgaacccgggaggtggaggtgtagtaagacgagatcgtgccattgcactccagcctgggcaacaagaggcaaactccgtctcaaaaaaataaaataaaaataaaagcaacgaaagtattatgatgttctaaatcctacctaaatattcttactcttaaagctatggtcataaaacccactggctttcttcaaaaggtagattacattattagaaagttgtaaagatatattatcaccaaactaaaactttgcttttgctttattcagaggaatttaaagataatagacaagaaatttctatttagggctatgtccctgtaccacactttagggaatgaaacactgtcatatgtcctgtcagataactgagttaaacatttcactttgcagttaacaaaacagctagagcctaggtataatgctgtggtatgtgtcttagtttttgctttttccgttctctcataataagtgatcctgagtatgtct

SEQ ID NO: 415959 - DNA, 2155 bp, Homo sapiens
  misc_feature (2155)..(2155): n is a, c, g, or t
caccggcgcaatctgcgtcccgcctcctccgctccctgcgctcccgccacctcggcaactccgcgcccgcctcccgcctccgtcggaagcctccgccgcagtaaggctcccggtctcgctgctgtctctttaaatggtggggctacgagccgcccctgcagctgctcccgggcggcacgatgaccgacacccggcggcgggtgaaggtgtacacgctcaacgaggaccggcagtgggacgaccggggcaccgggcatgtgtcgtctggctacgtggagcggctgaagggcatgtccctgcttgtcagggctgagagcgacggttctctacttttagagtcgaaaataaatcctaacactgcataccagaaacaacaggacactctgattgtgtggtctgaagcagaaaattatgacttggcccttagctttcaagaaaaagctggatgtgatgaaatttgggagaaaatatgtcaggttcaaggaaaggacccttccgtggacatcactcaggaccttgtggatgaatctgaagaggagcgttttgatgatatgtcatcgccaggcttagaattgccatcttgtgaattaagtcgccttgaagaaattgcagaacttgtggcatcatctttaccttcacctcttcgtcgtgaaaaacttgcactggcactagaaaatgagggttatattaaaaagctcctggagctttttcatgtgtgtgaagatttggaaaatattgaaggactgcaccacttgtatgaaattatcaaaggcatctttctcttgaatcgaactgctctttttgaagttatgttctctgaagaatgtataatggacgtcattggatgtttagaatatgatcctgctttatcacaaccacgaaaacacagggaatttctaacaaaaacagccaagtttaaagaagtgattcccatatcagatcctgagctgaaacaaaaaattcatcagacatacagagttcagtatatacaagatatggttctaccaactccttcggtctttgaagaaaacatgttatcaacacttcactcttttatctttttcaataaggtagagattgttggcatgttgcaggaagatgaaaaatttctgacagatttgtttgcacaactaacagatgaagcaacagatgaggaaaaaagacaggaattgtaactttttgaattttgtgcgttttccccgctacagcctctagaagtcatccttggcatggatgatacacaggtgcgaagtgctgctactgatatattctcatacttggttgaatataatccatccatggtacgagagtttgtcatgcaggaggcacaacagaatgatgatgatattttgctcatcaacctcattatagaacatatgatttgtgatacagatcctgaacttggaggagcagtccagcttatgggcctgcttcgaactttagttgacccagagaacatgctagccactgccaataaaacagaaaagactgaatttctgggtttcttctacaagcactgtatgcatgttctcactgctcctttactagcaaatacaacagaagacaaacctagtaaagatgattttcagactgcccaactattggcacttgtattggaattgttaacattttgtgtggagcaccatacctaccacataaagaactacattattaataaggatatcctccggagagtgctagttcttatggcctcgaagcatgctttcttggcattatgtgcccttcgttttaaaagaaagattattggattaaaagatgagttttacaaccgctacataatgaaaagttttttgtttgaaccagtagtgaaagcatttctcaacaatggatcccgctacaatctgatgaactctgccataatagagatgtttgaatttattagagtggagattttaatcttacggtcagtatgaattctgaaagcggagagtgatatgttcaaatttagggtgacgggttgacatagggaaggggaatcaatgaaggaggttccttgggatcgattggaagttcgactgaagtggaaggggtcattgagtcggatgagagggcctgtaaaagagaatgtcatgggagaaaagaagcgagatgggggggggaaaaagtgggggcaacgaggctgaaaatggcgttn

SEQ ID NO: 415960 - DNA, 234 bp, Homo sapiens
ctgcgctcccgccacctcggcaactccgcgcccgcctcccgcctccgtcggaagcctccgccgcagtaaggctcccggtctcgctgctgtctctttaaatggtggggctacgagccgcccctgcagctgctccctgggtggccccgcgcgccgcttttgaggggcgaaccaagatggcggcggttttggctgtgtgaggaagacggaagagacggcggcggagggaaaccgact

SEQ ID NO: 415961 - DNA, 310 bp, Homo sapiens
ggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctgagcctgcaagttcagcacgggcgtcctacagttcaggaagactacctcagtgacagagtccctgggaatgaaggagttaagtttttgggacaagtgtctg

SEQ ID NO: 415962 - DNA, 541 bp, Homo sapiens
ggaaaccatggtaaattttacccagttcattgcatatcgttccgggaagcgataaagacccatggttcgagtaattatattctaaattaggcgacagatagtagccaaatggtcctataatgcccttggataagaaaaggaaacttttgagctgcaccttcagtttatcctcaaagcctgcgttgtttgtcttcatctaatccagctttgatggacatctgtgatggttgcctgtacacttgctgaaatgaaatattagaaatggctgtatattccaaagaaaccctatattatatatccacattactgctgctaggattcatagttgcacatactgtttattgcttatgtgtagaaggaatgaaactagtttccagagttgttattaatatgaatatatatcatgtgttaatattgagaaaggaaaaatacattcccggtgttagtagttcttcatttcctgtctccaacagaaaattcactcattttagaactagtgtaattcttgataataaaataagagttttgattaagaacagca

SEQ ID NO: 415963 - DNA, 1381 bp, Homo sapiens
  misc_feature (134)..(134): n is a, c, g, or t
gggattatggggtatagagctcttctcccctccccccctcaagtaaagttgtcactgataataatccgatccctttaccctattccaagctcccaatagaaagaatttcgaaggctgaggacacatgttaaggnggccagaacttgtgggaaggctgtgatgggattttgggagacactttcgggcccactcagcctcttagtgacagagtcattagagctgcatttcagtagccaaagaggacaggaacaagtctgtcttcatgaggaatggtcctataatgcccttggataagaaaaggaaacttttgagctgcaccttcagtttatcctcaaagcctgcgttgtttgtcttcatctaatccagctttgatggacatctgtgatggttgcctgtacacttgctgaaatgaaatattagaaatggctgtatattccaaagaaaccctatattatatatccacattactgctgctaggattcatagttgcacatactgtttattgcttatgtgtagaaggaatgaaactagtttccagagttgttattaatatgaatatatatcatgtgttaatattgagaaaggaaaaatacattcccggtgttagtagttcttcatttcctgtctccaacagaaaattcactcattttagaactagtgtaattcttgataataaaataagagttttgattaagaacagcatagagcttcaaaatgcaaagtgaatgattagtaaaattatgtctcattttattttttcagcacccataccacaattaatattaggctggattgccatgggaaacattttttggcattaatgcagcaacataatactcactttaggtattactacatagttgaaggatttaactgaatgtatggatcaaatttatttatttgacatattcgaagctgtggtttaataggaatttgagaaaggtgtaagaaataggataaaaagaaggtcagcaccatgtaccaggaatagctttactttccatacatagaaatataaatttagtggtatcctatattactttagtgtcgtacgctttgtaagacttaaatattttattctattgattccacttctttggtatgttaagacatttctttaaagatgaccaacaatatccttattttaggtgccactagcagatgtaagcgtatacttagttgccgttagatgtgacagaatgagataatttatgtaaagcagtagagtacctggcacaaagcaaacaataaatattattgttattgttgttataattgtaaaatgaatgacttcaaaaacatagtcccagtttggagggattttgtgatgcagaatatctaagtcatagaaatagaagacaggtggaataagtatatgttc

SEQ ID NO: 415964 - DNA, 878 bp, Homo sapiens
accggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctgacagctggggagacattgcttgtacctctaggttccctgtctggcttccccttcagagcctgctgttgtaccaggtggttgaatcttaaaactctttaataccaaatagcaatcaaattcccccttacagataaaggtttcaccttttttattcagtttgctttcatctttgtgaacaaaaaagtcatcctaatactagtacatgtaataactaagcaatatgctatgttaagagaaatgactgagcagaccagtctgtctaggactaaattggcaagaattctaaagctgaatttatatctgggtga

SEQ ID NO: 415965 - DNA, 947 bp, Homo sapiens
accggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctgacagctggggagacattgcttgtacctctaggttccctgtctggcttccccttcagagcctgctgttgtaccaggtggttgaatcttaaaactctttaataccaaatagcaatcaaattcccccttacagataaaggtttcaccttttttattcagtttgctttcatctttgtgaacaaaaaagtcatcctaatactagtacatgtaataactaagcaatatgctatgttaagagaaatgactgagcagaccagtctgtctaggactaaattggcaagaattctaaagctgaatttatatctgggtga

SEQ ID NO: 415966 - DNA, 1077 bp, Homo sapiens
  misc_feature (536)..(536): n is a, c, g, or t
  misc_feature (539)..(539): n is a, c, g, or t
accggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaaaaacaaaaaaaaaaanaanaaacacaaccacaaacacacacaaacaaaaaaaaaccaacaacacacaagaacaacacacacaacgccgcaccgaaaacagacaccagagcagccgacacaagacagcgcggaggcgacagcagcggacaagagcacacacggagagcggcggaagggagagcaggagacaacacacagggactaagaacagaccgagacacagaccagaagaagagacggaagaaagacagacagagagcaaacagaaacaaaaaaaaaaaagatcggaggaaggaaacaagacaccgaagaaagggaagcacgagagcgagaagagagagcaaagaagcacgggggagggcgagctgacacgaaccaagacgaagagcagaccaccaacagagcaagcaaaagaaaaatcaacaagacgtgtccagatgaggtaagccatgaagcagccatcagcaagcagcagagaacgtagcggcaaaaggacacaggcgaggcaagaggagccacgactgagcaggcaggtgagctactgaagacagagaaag

SEQ ID NO: 415967 - DNA, 669 bp, Homo sapiens
  misc_feature (553)..(553): n is a, c, g, or t
  misc_feature (556)..(556): n is a, c, g, or t
  misc_feature (566)..(566): n is a, c, g, or t
  misc_feature (569)..(569): n is a, c, g, or t
accggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaaaaaaaaaacaaaaaaaaaaaaaaaacacaaaancanacaacacaanaanacaagcaacacgcaagcccaccacacccacaagacgcaccccaacagaagacagaaaccgggccccgacccagagacccacagggggcccacccaccccc

SEQ ID NO: 415968 - DNA, 657 bp, Homo sapiens
  misc_feature (541)..(541): n is a, c, g, or t
  misc_feature (544)..(544): n is a, c, g, or t
  misc_feature (554)..(554): n is a, c, g, or t
  misc_feature (557)..(557): n is a, c, g, or t
accggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaataaaaaaaaaaaaaaaaaaaaaaaaaaaaaaaaaaaaaacaaaaaaaacaaaaaaaaaaaaaaaacacaaaancanacaacacaanaanacaagcaacacgcaagcccaccacacccacaagacgcaccccaacagaagacagaaaccgggccccgacccagagacccacagggggcccacccaccccc

SEQ ID NO: 415969 - DNA, 833 bp, Homo sapiens
  misc_feature (494)..(496): n is a, c, g, or t
  misc_feature (502)..(502): n is a, c, g, or t
  misc_feature (528)..(528): n is a, c, g, or t
  misc_feature (534)..(535): n is a, c, g, or t
  misc_feature (549)..(549): n is a, c, g, or t
  misc_feature (551)..(552): n is a, c, g, or t
  misc_feature (554)..(554): n is a, c, g, or t
  misc_feature (563)..(564): n is a, c, g, or t
accggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaataaaaaaaaaaaaaaaaaccgggggnnncaaggngggggggggaaaagggggtatggaangggccnngggccataagcggntnncnggacccagnntttctggtcacaacagggggtagatctggccgggtcatcccaaataggagagccggattaaaattccgagaaaacgccaggggtgtaacccggggcgtatgagcacgcgggaaaacccaacgagcaaaaacacacacgacagcaaaagaagacacacaaactgggaaccaaagcggcacagcagcaaccacacaagcaacaggcaagaacaagcgagcaaggacaaacaaacagcccagacacaagcagcgacacaggacagacaagaa

SEQ ID NO: 415970 - DNA, 488 bp, Homo sapiens
accggaagaggcggggccaccggagtgcctaagagctgtcttccgatgtcgctcttcctttcccgcgcgaccggcgagggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacataataggagacacactctgtcagggacctctgagttaa

SEQ ID NO: 415971 - DNA, 958 bp, Homo sapiens
  misc_feature (24)..(24): n is a, c, g, or t
  misc_feature (69)..(69): n is a, c, g, or t
  misc_feature (96)..(96): n is a, c, g, or t
  misc_feature (451)..(452): n is a, c, g, or t
  misc_feature (456)..(456): n is a, c, g, or t
  misc_feature (460)..(460): n is a, c, g, or t
  misc_feature (464)..(464): n is a, c, g, or t
  misc_feature (466)..(466): n is a, c, g, or t
  misc_feature (470)..(470): n is a, c, g, or t
  misc_feature (920)..(920): n is a, c, g, or t
caaaggaattaaaatcaaggtccnggcaacatgagccaaaaccctttttccctgggccttaagaaagancagatttctcgtgccgaattcggcacnaggaggaagaagcgcgaagagccgttagtcatgccggtgtggtggcggcggcggagactgcgggcccgtagctgggctctgcgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaaaaaaaaaacaaaaaaaaaaactcnngagnaatnagtntnctcntctcctctctctttcttcctctcttttaagaaattgtgggtctatagagaggggtttgggggttttttaaaggggaaagggcccctctctttcattgtattgttgtggtgtggcccaatggattagatgggtgctccccctggtgcaaaattttatggggtagtttctgggggggtctttgatcgccagttcgtaacgctggggggtatgacgcggtttgggggccacgcctggggcgcatatccgggatgggcgccgaggaatggctggttcccttcccggtccccaaggggcgtgggcgacacggtgttgtcaggacgggggactctatcaatcggggagtttccaattttaacctcccgtggaacctaaaaagctttaaaaggcccatatgggtccgcctcgaaccaaaccggggggctttggagcgctgaagcagcaaggggggtnctcgcggagggaggaacaagggtctccgccgggaaaag

SEQ ID NO: 415972 - DNA, 715 bp, Homo sapiens
gtgtggtattctcaacattagttttttgaggggcacttgtgaatattgaggttatatgagaactttgagtatggaatgattttcactgtggtttctgactttgttttggaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctgacagctggggagacattgcttgtacctctaggttccctgtctggcttccccttcagagcctgctgttgtaccaggtggttgaatcttaaaactctttaataccaaatagcaatcaaattcccccttacagataaaggtttcaccttttttattcagtttgctttcatctttgtgaacaaaaaagtcatcctaatactagtacatgtaataactaagcaatatgctatgttaagagaaatgactgagcagaccagtctgtctaggactaaattggcaagaattctaaagctgaatttatatctgggtga

SEQ ID NO: 415973 - DNA, 733 bp, Homo sapiens
gctgaggtatggtggcctgcatgtattgttagcggttaggcgtacggccaggtcttgtgaatattgaggttatatgagaactttgagtatggaatgattttcactgtggtttctgactttgttttggaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctgacagctggggagacattgcttgtacctctaggttccctgtctggcttccccttcagagcctgctgttgtaccaggtggttgaatcttaaaactctttaataccaaatagcaatcaaattcccccttacagataaaggtttcaccttttttattcagtttgctttcatctttgtgaacaaaaaagtcatcctaatactagtacatgtaataactaagcaatatgctatgttaagagaaatgactgagcagaccagtctgtctaggactaaattggcaagaattctaaagctgaatttatatctgggtga

SEQ ID NO: 415974 - DNA, 401 bp, Homo sapiens
tttaatagctggcacaatgatgacttaaattactttttgccgtttacccagctgaggttgtctttgaagaaataattttaagactgagatgccagtactgtacattgattaattactgacatgtatgtaaggcaataatttaattaagggtgaatattctttgtttttagcatataggttgctgtagatgaatgttcttagctgtcatgtttaaaaatacttctgcttcgttacctcaagtaagtgatttgtcaagcaactatgtctgctgacagttcagaaagtatctgataaacttaagggtgggggcagattcttgttgaagttgcttttgcatgtgtggtattctcaacattagttttttgaggggcacttgtgaatattgaggttatatgagaact

SEQ ID NO: 415975 - DNA, 966 bp, Homo sapiens
  misc_feature (24)..(24): n is a, c, g, or t
  misc_feature (69)..(69): n is a, c, g, or t
  misc_feature (96)..(96): n is a, c, g, or t
caaaggaattaaaatcaaggtccnggcaacatgagccaaaaccctttttccctgggccttaagaaagancagatttctcgtgccgaattcggcacnaggaggaagaagcgcgaagagccgttagtcatgccggtgtggtggcggcggcggagactgcgggcccgtagctgggctctgcgaggtgcaagaaagcctttgaggtgaaggtgtatgaaagtcatcataacagatgttttccaaaaacttgtagaaggttgtgaaaaaactactaggatcacgcggcatgtattgagcatataggttgctgtagatgaatgttcttagctgtcatgtttaaaaatacttctgcttcgttacctcaagtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctgacagctggggagacattgcttgtacctctaggttccctgtctggcttccccttcagagcctgctgttgtaccaggtggttgaatcttaaaactctttaataccaaatagcaatcaaattcccccttacagataaaggtttcaccttttttattcagtttgctttcatctttgtgaacaaaaaagtcatcctaatactagtacatgtaataactaagcaatatgctatgttaagagaaatgactgagcagaccagtctgtctaggactaaattggcaagaattctaaagctgaatttatatctgggtga

SEQ ID NO: 415976 - DNA, 584 bp, Homo sapiens
agcgcgaagagccgttagtcatgccggtgtggtggcggcggcggagactgcgggcccgtagctgggctctgcgaggtgagagtgatcgcggtcttaggtccaactcctctacgtgccgggttcctccgccatatgggtgcccagcgcggcccctgtcccttccccgggcgcagcggagcgggcggctgctgcgtaggccaaaaggctacgctcccggtgcccccaaggcccacgagctttccccacaagccatttgcgcagtcgcgttttgtgagtaaccacctggaaggcttagctgacctttctccgtcaacaccggttcgctgtcctctgctcagaaactgggcaagggccttctgacttaaggaggtgcctgcaagggaccgtcgggaggcttcgtgctccacccggtcttggccagatctctcttgtgtccccagcaaagttgtgcgtgcggccttggcggtttcaggctcttaggcagcttgttttccttaaaagggagcgttttataaataggaaggtgattatcccttaggtgtcaggacgacccttagttaaccgtactttgtgagtggctttga

SEQ ID NO: 415977 - DNA, 1118 bp, Homo sapiens
caccattaaatttatattaacatgtaaaaatgtttggagtttagggctctttacccatatcttagtgacataggaagaaaattaagataaatcacaagcaactagaaaatagacatgttaactttattttagtacatactctggtaggatttttacataatcttacgtactagtcagccttcttagaagtgtcacatagtcaatatccttaaagagaaatggaagctaatcaggtaagtaaattgtgagctgaggcctacatcatgcttgctattcaaagagaataaagtaattggataaatgataatgcctccttgttgggaaaacagtcttcaaaaatggcactaagttacagttctaatgcaatagagtcactaattactatgaatacttgttttacttggcagattactaacaaagttaattggatacaataaatgtaaagattttcttttaaaacgacagattcttcagtgaggtgtaaacattttatagaacaattatcaaagctatattggacttaaatattggtcatgaatgtatgcacaccccataggtagctgccctccttgggcagcttttgactcctatgccaaattttaaaataaaggccgtggccaggcgtggtggctcatgcctgtaatcccaacacttcaggagtccaaagcgggcggatcgcgaggtcaggagatcgagaccgtcctggctaacacggtgaaaccctgtctctactaaaaatacaaaaaaaaaaaattagccgggcgtggttgcaggcgcctgtagttccagctcctttgggaggctgaggcaggagaaggatctgaacccgggaggcagaccttgcagtgagccaagatcgcgccactgcactccagcctgggcaagagcgagactccatctcaaaaaaataaaataaaggccatatgtttaatcacattccccaaaaggagaacttcataaggcactaatgagtaatgtttattttacgaatgattttacgggaaaaattacagaggatgtttaaattgcaaaaatactcctccccttttttctcctccaccgccccccaaaaaaaatcctttgcagttatcacctaagctttttgggtgtgtgattta

SEQ ID NO: 415978 - DNA, 1046 bp, Homo sapiens
caccattaaatttatattaacatgtaaaaatgtttggagtttagggctctttacccatatcttagtgacataggaagaaaattaagataaatcacaagcaactagaaaatagacatgttaactttattttagtacatactctggtaggatttttacataatcttacgtactagtcagccttcttagaagtgtcacatagtcaatatccttaaagagaaatggaagctaatcaggtaagtaaattgtgagctgaggcctacatcatgcttgctattcaaagagaataaagtaattggataaatgataatgcctccttgttgggaaaacagtcttcaaaaatggcactaagttacagttctaatgcaatagagtcactaattactatgaatacttgttttacttggcagattactaacaaagttaattggatacaataaatgtaaagattttcttttaaaacgacagattcttcagtgaggtgtaaacattttatagaacaattatcaaagctatattggacttaaatattggtcatgaatgtatgcacaccccataggtagctgccctccttgggcagcttttgactcctatgccaaattttaaaataaaggccgtggccaggcgtggtggctcatgcctgtaatcccaacacttcaggagtccaaagcgggcggatcgcgaggtcaggagatcgagaccgtcctggctaacacggtgaaaccctgtctctactaaaaatacaaaaaaaaaaaattagccgggcgtggttgcaggcgcctgtagttccagctcctttgggaggctgaggcaggagaaggatctgaacccgggaggcagaccttgcagtgagccaagatcgcgccactgcactccagcctgggcaagagcgagactccatctcaaaaaaaaaaggaacgtatccttaatgagagcctcctctagctggccaactatagagggcccagtcccaatatgcttttctcagggtcccaggttggtggcttcactgggcatctagcaagtctcgggcacagtcccttggtatg

SEQ ID NO: 415979 - DNA, 600 bp, Homo sapiens
gccgcccggctgcggggagcggcctggggcaggactgggagctgggtgtggtcccggggcactctggagtcagccattagagctgccctcggaacggccttgcacaaacgcctaagacctgtaaggtccctcactgctgagccggacgggaggtccccgcgcctccccacgtttgtgtgaggctgatggcgcgtcggagtccccggcgctccgcccagtcggcccagactgcagctcccggctgagatgtgtctttgccgccctcttctcccccagagggcccagtatcaagacaagctggcccggcagcgctacgaggaccaactgaagcagcaggtgagctcagcctcccctgcgaggcgcctgcgtccctgagaacgtaggtggctttgtgggaccagtcagtgggtcagaggccacggggcaagaacgatggggttgctgacggtgggtgctagagcaggggaaactactcggacagacacgcaccagcacacgtgtacaggcacacatgcagatgtgtgcacacatgtacacggagacacaggcacctgcccacacagacacacactcctcgcacacacactcccggcagacagg

SEQ ID NO: 415980 - DNA, 534 bp, Homo sapiens
cccctcactcttcttgtccagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaagtgagggagcccctcgggtcctgagcccccgggcagggctgtgcagccgtcgcccttggttcccactgagggtccctggctcacagtgctgggcaccagctgtggcctcagtgtgcccacctcagatgtcccctgggaacggcccagctcgggacagcacggggtgtcattgaggaacatgcaggggcctcccgggcagagctggggtcagtcctgtcttcacggccctgtgcgccgccgccccagcttgcaggtccctctgccc

SEQ ID NO: 415981 - DNA, 460 bp, Homo sapiens
ccgcggccggacgctgctgtgggctgctcctggcgtcactctcgccttgcttggcctctctctcgttcacagcctcctgctcttcatggatgaagcagacgccttccttcggaagcgagccactgaggagataagcaaggacctcagagccacactgaacgccttcctgtaccacatgggccaacacagcaacaagtgagggagcccctcgggtcctgagcccccgggcagggctgtgcagccgtcgcccttggttcccactgagggtccctggctcacagtgctgggcaccagctgtggcctcagtgtgcccacctcagatgtcccctgggaacggcccagctcgggacagcacggggtgtcattgaggaacatgcaggggcctcccgggcagagctggggtcagtcctgtcttcacggccctgtgcgccgccgccccagcttgcaggtccctctgccc

SEQ ID NO: 415982 - DNA, 4726 bp, Homo sapiens
  misc_feature (4654)..(4654): n is a, c, g, or t
  misc_feature (4692)..(4692): n is a, c, g, or t
gtgggtgcagggggagaggggtcttcacagctgcaggggaggctcctccacagccaccctccccccaacacgcctgcaggtgggcgtgggcactggttgccttttctagaaccatttgaaagttagctgaagacagcatggcacactcccttcaataggtcccacagtgaccccgcgcaggcacagcccgggcacccttgtggcctcggctgtcctcgttggaaccacgcctggctaatgttgtattttagtagagacggggtttctccatgttggtcaggctggtctctaactcccgacctcaggtgatccacccgcctcggcctctcaaactgctgggattacaggcacgcgccaccacgcctggcctattttattttattttgagacagagtgtcactctgtcccccagtctggcgtgcaatggtttgatctcggctcactgcaacctccacctcccgggttcaacctcctgcctcaggccttccgagcagctgggactacaggagcctgccaccacatctggcgaatttttgtatttttagtagagaagggggttcagcatgttgtccaggttggtcttgaactcctgacctcaggtgatccagccactttggcctcacaaagtgctgggattataggcaagagcgatggcgcccggcccactcagcaggattcctagaatgggcacgagctctgccctcatcacagtccaaaagtgagcacctgcctggagctgcccagaaacagccttgtggggtggggttggtgtctgacctccctccccgggggccttcgcaggcttctctgctggtgcttctgtgcctgtgggtctggattcctccagggcctgatcctgggtgcagatgcagctggaagccctgaacctgctgcacacactagtctgggcacggagtctctgccgtgccggagctgtgcagacacaggagcggctgtcaggcagtgccagccctgagcaagtgccagctggtgagtgctgtgctctgcaggagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcaccgccgtgtctctctattgactgacactgctcggggtttcaggggcgccctagcgtcctcctggggtcaaaggtgacataagaggcagaggctggagctttctagaatttactgatcacagagcggtgtgcttcacatcagcctcgcgccacatccgagttggggtctgaatgctgcccgggactgccgcctgcgccccaccagcccctccctcctgaaggaggggcaccccgagaagaatgaggctgcagagtgatgtgggggccagcggtgacttcatgaccacactgcgcccaggtgtaagagggcacgcttctgcccaggcatcgtccatggaagacacgcagtcggccactgcagcctcggtcctgggtgccctggggctgggtcactgggggccacaggccacactgggagaccacagtcctggcatgccatgcagctccctgtccccagaggtctgctcagatgcagagagctcaggaaccacactcgctgcctgaattctgggagcagagcgtggtacccactgcctggctggggcctactctgggactgcagcccctgtccccgctggcccaggcttccggaggcagctgcgtccctgtcttggctcaaggtcaggccggaggccaggctgtccacctgcatctggaacctgcacagtcactcctccaggtcctcgctgctggaggactctcagacaggaaacctttgctttgggggcagggtggggtgcaggggtggttgggggaatcacagcaacgagacagcacagtgccatggcgcagagcctcatattggtcgatgaaacaatgctttctgaactttgtgtccttaggaagggtgtaggctgttggttgaagtaggaaacagaagaggagcctgggcacgcaacggtcccatcggagagcagacccctcggagctgcagtgcttggaggggggcggtctacctctgctcgctctctccatttctctctctacctctgctcgctctctccatttctctctttttccttttagagatgggttcttactctgagcccaggctggagtgcagtggtgtgattatagctcactgcagcctcgacctcccaggctcaagtgatcctcctgcctcagcctgtccagtagccataccctactaggccctaattagccccagaggcgtgcaccaccacgcccgctaatgctaaaaatttgttgtagagaccgagtcttgctataatgcccaggctggtctccaactcttggcctcaggagatcctcccgcctctacaggatgagccaccaagcctggcctcaattcctctttaaaggaattgcctaaatcttaaaccagcaatcaatactttgtatttaaaattaagccaggttagactgggctaggtggctcacgcctgtaatcccagcactttgggaggccaaggcgggtgaatcatgaggtcaggagtttgagaccatcctggctaacgtggcaaaaccccgtctctactaaaaatacaaaaaaattagccggcatggtggtaggtgactgtaatcccagctactcgggaggctgaggcaggagactcgcttggacctgggagggngaggttgcagtgagccgagatcacgccactgcactccngcctgggcagcatggcaagaacctgtcgctcttt

SEQ ID NO: 415983 - DNA, 2483 bp, Homo sapiens
ggctcataaggaaaggttaaaacacagaaatgaaaactcgaaatagttctttctccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcac

SEQ ID NO: 415984 - DNA, 1645 bp, Homo sapiens
gggtgaccggccctatgtccaggctccctcttccctcccaaatcccttaattttgagttttcttggtctcctgggcccctccagccccagtcacgtgtcacacggaggatcaagtcctgctggtcggccgtggctgactcttcaggcacgttgggctcctgggtcagctgctgccgttcgacgctccctggagccctgactcaggtccttcccagagaggcaaggctggggccctgctgagcctctgctgaacccgggcccccgaggtcctgcttctggctcgcatggccataatcttgacagggactctgggtcccgcatccctgctcccagcacagcggggctcaggtagcaggagggagtggtgttcccggcactgcctatcaggctgggcgagggtcagcggggaagtaccacacagggcaagaacagaggcccgagaagccgggcggggggcagctgggcgtggtggggcaggcaggcgggtgaccagggctgtggctgcgttctccccgtgtttcctgtgctcacaagctgccgctttagattctcccaaaaagtctccccgagggggctgaggagcccccgttgccctcggggcatctcagctggcagccccagcgtttccttccccatccctgtcctacagattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcac

SEQ ID NO: 415985 - DNA, 1547 bp, Homo sapiens
ggagcttttgggtcctgagatgcaactgcttggactgtgccggggatagataggctgcccacgagctgggcggcttcctgaggagcagagtccgcacccgggcattcccgcagcccctgtcaccgaggcttccgtgggtgcagagtgtctcccccaaacccccgtcttccccggcagcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcac

SEQ ID NO: 415986 - DNA, 2358 bp, Homo sapiens
ggctcataaggaaaggttaaaacacagaaatgaaaactcgaaatagttctttctccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattggactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcac

SEQ ID NO: 415987 - DNA, 2507 bp, Homo sapiens
ggctcataaggaaaggttaaaacacagaaatgaaaactcgaaatagttctttctccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccactgtgagggtgggtgctggctgagcccctggggcagaaggagtggggcaggcggggtctttgttctcggctcccacagcagagccaggtgagggggggcctgccaggactagacagaagtggggcggcctgaaccctgcttccagccatggccaggggccacggaacccggcaggggtgtctgaggccgccctgtcagctggccggtccaagcctgtggctggagctggtgtgtgtttatctaataaagtcccacaggtgcctcacaaaaaaaaacaaaaaagcaaaaag

SEQ ID NO: 415988 - DNA, 2472 bp, Homo sapiens
ggctcataaggaaaggttaaaacacagaaatgaaaactcgaaatagttctttctccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtggctgggctgacgctgctggctgtcggggtctactcagccaagaatgcgacagccgtcactggccgcttcatcgaggctcggctggggaagccgtccctagtgagggagacgtcccgcatcacggtgctggaggcgctgcggcaccccatccaggtcagccggcggctcctcagtcgaccccaggacgtgctggagggtgttgtgcttagtcccagcctggaagcacgggtgcgcgacatcgccatagcaaccaggaacaccaagaagaaccggggcctgtacaggcacatcctgctgtatgggccaccaggcaccgggaagacgctgtttgccaagaaactcgccctgcactcaggcatggactacgccatcatgacaggcggggacgtggcccccatggggcgggaaggcgtgaccgccatgcacaagctctttgactgggccaataccagccggcgcggcctcctgctcttcatggatgaagcagacgccttccttcggaagcgagccactgaggagataagcaaggacctcagagccacactgaacgccttcctgtaccacatgggccaacacagcaacaaattcatgctggtcctggccagcaatctgcctgagcagttcgactgtgccatcaacagccgcattgacgtgatggtccacttcgacctgccgcagcaggaggagcgggagcgcctggtgagactgcattttgacaactgtgttcttaagccggccacagaaggaaaacggcgcctgaagctggcccagtttgactacgggaggaagtgctcggaggtcgctcggctgacggagggcatgtcgggccgggagatcgctcagctggccgtgtcctggcaggccacggcatatgcctccaaggacggggtcctcactgaggccatgatggacgcctgtgtgcaagatgctgtccagcagtaccgacagaagatgcgctggctgaaggcggaggggcctgggcgcggggtcgagcaccccctatccggagtccaaggcgagaccctcacctcatggagcctggccacggacccctcctacccctgccttgccggcccctgcacatttaggatatgctcctggatggggactgggctgtgcccagggcctctgtcccccaggatgtcttgtggtggcggtcggccgttctgccccccagggcaccccctgttgtaggcactggctagggaggggcaggcctccttcctgcccctcgagacactcttgggagatgcattttccgtctggctcacagggggagggtgaggctttgtaccccagcccctgcccaggccaattgcaactctgctactagtctagccactagggccttggaaattgcccggcgttctctatatcggctccagaaccacttcaagcaagagactctctccagctctagccactgtgcggctctcatccattgcaatctatccttacccactattcctagccttccaactttagccaatctcgcatttgtcattctctcgctcgctctctacctacagggtcgccctgtaccaacccttaacacgctcttgtgctccc

SEQ ID NO: 415989 - DNA, 1416 bp, Homo sapiens
ggctcataaggaaaggttaaaacacagaaatgaaaactcgaaatagttctttctccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtaaacatattcataaaacagggctggcaggtggctgagaggcagcatgtgggggcctcctggagccccaggtcctgtccctgccggctctgcacagccctgtagctctcccagcacagagcaaacccacgttgtacctgctgggctcggctgctcctccctccttgagctgggagaaaaaaatgcagttgccagcctgggccacacggtgagaccccatctctacgaagaataaaacattagctgggtgtgatggtggcgcctgtggtcctgctactcgagaggctgaggtaggaggatcacttaagcccaggaggtttgggctgcagtgagccaacattgcaccactgcactccattcttggcgagagaataagaccttgtctcaagaaaaaaatggccaggcggtagtggctcaggcctgtaatcccagcattttcggaggcggaggtgggcggatcacgaggtccggagatcgagatcatcctggtaagagtgaaaccctgtctctactaaa

SEQ ID NO: 415990 - DNA, 1028 bp, Homo sapiens
ggctcataaggaaaggttaaaacacagaaatgaaaactcgaaatagttctttctccaccggctcgcggcgcgtggaggctgctcccagccgcgcgcgagtcagactcgggtgggggtcccggcggcggtagcggcggcggcggtgcgagcatgtcgtggctcttcggcattaacaagggccccaagggtgaaggcgcggggccgccgccgcctttgccgcccgcgcagcccggggccgagggcggcggggaccgcggcttgggagaccggccggcgcccaaggacaaatggagcaacttcgaccccaccggcctggagcgcgccgccaaggcggcgcgcgagctggagcactcgcgttatgccaaggacgccctgaatctggcacagatgcaggagcagacgctgcagttggagcaacagtccaagctcaaagagtatgaggccgccgtggagcagctcaagagcgagcagatccgggcgcaggctgaggagaggaggaagaccctgagcgaggagacccggcagcaccaggccagggcccagtatcaagacaagctggcccggcagcgctacgaggaccaactgaagcagcagcaacttctcaatgaggagaatttacggaagcaggaggagtccgtgcagaagcaggaagccatgcggcgagccaccgtggagcgggagatggagctgcggcacaagaatgagatgctgcgagtggagaccgaggcccgggcgcgcgccaaggccgagcgggagaatgcagacatcatccgcgagcagatccgcctgaaggcgtccgagcaccgtcagaccgtcttggagtccatcaggacggctggcaccttgtttggggaaggattccgtgcctttgtgacagaccgggacaaagtgacagccacggtaaacatattcataaaacagggctggcaggtggctgagaggcacattttcggaggcggaggtgggcggatcacgaggtccggagatcgagatcatcctggtaagagtgaaaccctgtctctactaaa

SEQ ID NO: 415991 - DNA, 1762 bp, Homo sapiens
agcgggacgtgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaataggctaagtgtaaacgcaaagtatgtttcactgtttatgattaataatattcatcttttctataaatactacttactggaacatt

SEQ ID NO: 415992 - DNA, 1711 bp, Homo sapiens
agcgggacgtgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagtatacaaatgtcagccaatgacatataacaaccatttcttataaaaccttgatgttcaaaagcctgactagcagtggcatccatgttgcttaggagttggtttggaaacaaagactttcaggccctacctatactagctagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacct

SEQ ID NO: 415993 - DNA, 1516 bp, Homo sapiens
agcgggacgtgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacct

SEQ ID NO: 415994 - DNA, 1025 bp, Homo sapiens
gcccaacaactccggcacgaagagctcgcaaaatttccggctccgagcaggcggagctgtggtttggttttaaaagtggaaaactagctgcacatatccttttttactgcagatttactttaaggctcatattctccaagtctattctgctttaaaaagaagacaagaaaagctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacct

SEQ ID NO: 415995 - DNA, 1570 bp, Homo sapiens
agcgggacgtgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacct

SEQ ID NO: 415996 - DNA, 1582 bp, Homo sapiens
gcccaacaactccggcacgaagagctcgcaaaatttccggctccgagcaggcggagctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacct

SEQ ID NO: 415997 - DNA, 2088 bp, Homo sapiens
cttcagatttttaggttgagaaaactggtatgcctttgccttcagaaagacacagtcagtccagggaaatataaatgaaaagagacaaccaccacagtaaaattgcgttcacaaatacacttacaaatgtatttctaagtaccagctttattctaagcttcaagatgaacacccaagaaaaaaaaagaacaccttgaatttctatttgaagttcagtttcttttggttgctaccaaacttcccctctttccaccaaaaaaatttgcatttatttcatacatgaagcaagaagctcaaggccacatttcttctgtaaagattggtgacaggttagagggtgggtagtttctgtaagaatgatccttaatttttttttttttttaaagaaggaatcagaaaagtaaaagcagaactaactgactcaaagcagaagtctagcacgcttcaaaggaagaaaactatataaagccatgatagtccacttaaaatgattaatatttatttgtaatgctaacttctagcatctaaaagtgttaatagaaattaaaatgcttcttcatacatagctgaatagaaaagaaatttagttgagaaggaattcagggtagcgaatattaggcataagcttgtagtttacttgtaacatctcaacactatcttttaactacaattaccaaaactaggatccattattctttcacaaactaacaaattatattgctatcccaacagattgccaagtatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttctttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacct

SEQ ID NO: 415998 - DNA, 296 bp, Homo sapiens
tccgccctcagcagccaatcaccatctacagtctgcactgccaaatgcgtagccctttattctctcatgccccgtgatccccatgaacattcagtagagatcactagagagcagtttgcacgtgagcgcagttttccataagaagcactctgaactgttgtttttctctaagcttttacatgaaatattgggaagaacttactgcatttctagaatggtaggaatctgttcttttggtgtttgtttgttttctcatgttcatctgtgtacaaataaaaaaaagagaatggtcgtaa

SEQ ID NO: 415999 - DNA, 422 bp, Homo sapiens
gctattgttctaatttgtatatattttaagtccctataatttaattgagcaaatatgtcttgagtatctatcatgtaccaggcactcctctagagcactgaggattcagctgtgatcaaaacagataattattgctctcacaattcctacattctagtagaggcagacaattaacatgaaaataacaatgatagcttcagataacgatctttaaaaataaaatgtaacagtttgcccagtgtatgactggaatgcgggatcaagtttagattggataatcaaggtaggaatgcgggatcaagtttagattggataatcaaggtagggatatctcagagcagggctttgaggtgagacttaaatgatgaggggccttttaagtaaatgtctggaagaagtgaatttttcaggaagagtcctgg

SEQ ID NO: 416000 - DNA, 2235 bp, Homo sapiens
  misc_feature (794)..(794): n is a, c, g, or t
  misc_feature (802)..(802): n is a, c, g, or t
  misc_feature (810)..(810): n is a, c, g, or t
  misc_feature (817)..(819): n is a, c, g, or t
  misc_feature (821)..(821): n is a, c, g, or t
  misc_feature (824)..(824): n is a, c, g, or t
  misc_feature (832)..(832): n is a, c, g, or t
  misc_feature (846)..(846): n is a, c, g, or t
  misc_feature (848)..(848): n is a, c, g, or t
  misc_feature (852)..(852): n is a, c, g, or t
  misc_feature (860)..(860): n is a, c, g, or t
  misc_feature (1531)..(1531): n is a, c, g, or t
  misc_feature (1533)..(1533): n is a, c, g, or t
  misc_feature (1537)..(1537): n is a, c, g, or t
tgactgtacctacattaaggtgttggtgttcaacacaagtgtacaatgtgctgggggcaaggggacacagaaaagaggcagtcaatggaagtccctagaaggggggagataaggttaggacaagccttcccaagagtagaaaaggatgatagttgtgttgggccctgaaagatgaataggatattgataagctgataacaaaggaagagagaaacgtaacagttactgagattctacaattgaccgggcactgtgctagggtcttttaccaaagggccatacagacagaggatgacatgagcaaagttacgcagacatgagagtacatgcccaatgcacttgaaaaccaaggtgcaaaccagcatggcagcattcaaccaataggtgaatggttcggtgtggcaggaaatgggcctagaaagttaaggcagggccaggtcatatgtcatcctgaacatcaagctagggcgtttgcaattatcctataatttggaaatatcctatagactctgttctaaggatgtggttcccagtggggaccactagagggttttaagccaagaataatctgcccagatgtaacctttagaaagaaataattgggagcagaatggaggattgcgggagaaaggctagtggtatggcaaactgctagacagctatgagtaaagtccaggacaaagatgagccagccctaaaacagagtcaagtgccattttgaagctgtgggtagacatcatggcaagatggtagcataactatgggtggccagataaagccctctgtaattcccntttaaatnactgcagnatatacnnngnccnttgcaccnctgttgatgattgngntaantaggcttncaatgtctgaaaaaaaatgtaggtcaaccactagtaaaattaaaagcaatgtctattttccaaatcactgctgaaaataatagcaaatcatttccacacacacaaacacacaaaagcataatctacaggaaacataaaatgcatagggcataaaacaaagtaataggaataaaaccagatcgaatggttatgaggtgaatgtaactagagagcccgtgagcctggatcatacacagctatcatttgttgagtgcatgctctatgccaggtgctcctctgtgtgtttcataaagacaaatatggcaatgggaggatgagatgggatgcttccagtctaggatccacttggggctccaaatgaacagataccacattccaaagtgaagtgggatacacctcttggaaaagaggtggcgaaaacctgggtccatgccattagctgacacccatctctaatgcatacaaaatgggagagaggttgaaaaaaggttgttggaggtttagaatgaatttcagagacagcctttggggtccagtgatcccaaataaatgggaggggtacagggtgctatcaccttcacctcaaagccagacagtggggccttgaggagacccctaagtcagttgatatgtggccaaaatggtcttggtgccacagtggagaaatccananagcngcaagagtctgctgcttcaggatcagcctgtgctccctggtttgcagggcaaagcacacatgagtgtctcttgtggacagaggtaggacccagcaagagagccagatgtgactgtcttagatccaggacaagagggctcctccaagggaggaggtgacactgagggagaccaggtttcccagagcctgagaaagaaaccataggatcggctacggggagaaagtatcaccctcatcaagggaggtgcagggtgagactccagcgatggggtggtctccaccaacccacaaaaacagcccagtgagagaaagggcccagagaacaacgggacagcaactcatcagagtacagtcattgaagacctttcccaaccatctcctctcctacctacctgcccctccaccttggaccctggaaagggtcaggactgtcatgtgcaaggtccccacaggcagctggcctacagcagactgtgctgggaaagaggtggtgtaactctgacgtttcaagattttttttttattacagcagacaggatgcattaattactgacaagacaacctctggttacctgaaaatggtcagaaaagtcatgggacttaccctaaatttaatataattttagaagggaaaacagccctatagaataaatttaaagagactgtgggagacaaaaataaagtttgctttatgattac

SEQ ID NO: 416001 - DNA, 310 bp, Homo sapiens
cccctcatcctgaaactacctaagggtttccaggcttcagtcaactcattagcatgcaaaaagacatcactttttggagattctaaggattctaggacatgtatgccaggaaaaaggatcaaagaccaagtatacacttcataatatcacagctccccatttccctaagataatttctagaggtcatggcctgacactcaaggttcttcaagagccaccccttcctacccttttaggcaatgtccagtcattctatcccttggtcactgaattccagccaccctagactttccacagttcctttgggtca

SEQ ID NO: 416002 - DNA, 1645 bp, Homo sapiens
tagcagttttaacattgcatatccttaagattttaatattccaagctgtgtacaattttagtacattcaaattctaaaggttatctctttatcttatagttctctaattacacattctccaactaataattttacatggaccacaaagtttaaaagcgatcttattagcctacaaatctccactgtcctcttattcctatagtgctgagcatgttaaaaaaaaaaaaaaaccttattgatcaaaaataaaacttgaattttgaaacatgcttaaaatgacatcagtagtcttccttaagaagtataggcttaactggggaatagtcaatattttaaaatttatttactatatgcatgttatatatacttgctttatgtgtattataaagcataatctatatttacaaaactgtaaaatacacacctctaataatgagttttaaagctttttttcttttgagacagtctcactctgttgcccgggctagtgtgcagtcatgcgatcttggctcactgcaacctccgcctcccgggttcaagcgattctactgcctcagcctcccaagtagctgggtgtggcacctgccaccatgcctggctaattttttgtatttttagtagagacagggtttctccatgttagccaggctggtctcaaactcctgacctcaagtgatccagccgcctcggcctcccaaaatgctgggattacaggcatgagccactgttcccagctggatttcttactctaagttacttatcttaaaaaaaaaatagtctaagattacaaattatcagttccagaagagatatacctaacacaaaaattaacctactaaattgaactatatgagtatcaatacaagcaacatgagtaagccttaaatttcatgtttttaaagcttacaaagggtgtaactaatttattcaactccaacactttattcttattacagaatcaaagcttttagacattaagaggaacaagggaggatctgaactattttaggtttaaaagcccatgatcagggatattaattgcagccataaataaactgctgaggccaaataaacaactgcattcctataatcgctgccaaaaacactgcatacatcctcaaacattgagacaaaggatggcagacaggtttcaactctaattgttatgtggctgcctccaacagtatattgagactggggaacaacgtggggcaggtttcaactctaattgttacgtggctgcctccaacagtatattgagactggggaacaacgtggggcaggtttcaactctaattgttacgtggctgcctccaacagaatattgagactggggaacaacgtggggcttgatgtcaaagagaactcagaaggattataaaagcctgtcgtgggcacaagaatgtggtaccttgtgctactcttggcttcagcattaagctgacaaagacttcctactgcaatacctgactttcgtttctattatgaacacgatatttcactgttgtttctcatcaaaagcacctgatgtcaatgtaacaaaatacagagatcatgaaattcttttttgctatgtccgacaaaatgaacaagaaactgaataccagttttctagatgcactaataaataacttcagttaaaata

SEQ ID NO: 416003 - DNA, 1415 bp, Homo sapiens
tagcagttttaacattgcatatccttaagattttaatattccaagctgtgtacaattttagtacattcaaattctaaaggttatctctttatcttatagttctctaattacacattctccaactaataattttacatggaccacaaagtttaaaagcgatcttattagcctacaaatctccactgtcctcttattcctatagtgctgagcatgttaaaaaaaaaaaaaaaccttattgatcaaaaataaaacttgaattttgaaacatgcttaaaatgacatcagtagtcttccttaagaagtataggcttaactggggaatagtcaatattttaaaatttatttactatatgcatgttatatatacttgctttatgtgtattataaagcataatctatatttacaaaactgtaaaatacacacctctaataatgagttttaaagctttttttcttttgagacagtctcactctgttgcccgggctagtgtgcagtcatgcgatcttggctcactgcaacctccgcctcccgggttcaagcgattctactgcctcagcctcccaagtagctgggtgtggcacctgccaccatgcctggctaattttttgtatttttagtagagacagggtttctccatgttagccaggctggtctcaaactcctgacctcaagtgatccagccgcctcggcctcccaaaatgctgggattacaggcatgagccactgttcccagctggatttcttactctaagttacttatcttaaaaaaaaaatagtctaagattacaaattatcagttccagaagagatatacctaacacaaaaattaacctactaaattgaactatatgagtatcaatacaagcaacatgagtaagccttaaatttcatgtttttaaagcttacaaagggtgtaactaatttattcaactccaacactttattcttattacagaatcaaagcttttagacattaagaggaacaagggaggatctgaactattttaggtttaaaagcccatgatcagggatattaattgcagccataaataaactgctgaggccaaataaacaactgcattcctataatcgctgccaaaaacactgcatacatcctcaaacattgagacaaaggatggcagacaggtttcaactctaattgttaagtggctgcctccaacagaatattgagactggggaacaatgtggggcaggtttcaactctaattgttacgtggctgcctccaacagaatattgagactggggaacaaagtggggcaggtttcaactctaattgttacgtggctgcctccaacagaatattgagactggggaacaatgtggggcaggtttcaactctaattgttacgtggctgcctccaacagaatattgagactggggaacaacgtggg

SEQ ID NO: 416004 - DNA, 400 bp, Homo sapiens
ctaattacacattctccaactaataattttacatggaccacaaagtttaaaagcgatcttattagcctacaaatctccactgtcctcttattcctatagtgctgagcatgttaaaaaaaaaaaaaaaccttattgatcaaaaataaaacttgaattttgaaacatgcttaaaatgacatcagtagtcttccttaagaagtataggcttaactggggaatagtcaatattttaaaatttatttactatatgcatgttatatatacttgctttatgtgtattataaagcataatctatatttacaaaactgtaaaatacacacctctaataatgagttttaaagctaaatgagcaaaatattcctctagtttttctttagcagttctgtgaatggatttttt

SEQ ID NO: 416005 - DNA, 2015 bp, Homo sapiens
ctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaaagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagagatgggggtttcaccctgttgcccaggctagtctcaaattcctggactgaagctatctacccgccttagtctcccaaagtgctaggattacagcgtgatctaccacacctggccaatcccaactactctggaagctgaagcagcaagatcacttgagcccaggagtttaagaccagcctgggcaacatagcaagaccctgtctctaaagaaaaaaaaaaagtaaaagaaaaataaagcacgtcttggctcagctgctgatttaagctgggtctaaac

SEQ ID NO: 416006 - DNA, 4461 bp, Homo sapiens
ctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcaggtaagcagaacccccaggctgaagtccacgcttaggatgtgactccaatctcagtgaatggcaggggatgctgctgtcagggacagacggaagagtccccagctctggagggcctgattgatggggagacagggccaaccctcaagtcagaatggtttaagggacagatccctaggcactgggaacactcagcccctgctctgacaatcctcactctgattgagaagctcagtttgaccccagggagctccatctgatgggggaggctcagccccaccctggggacccatgccagccactcccatcctgtggtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaagtgagggctgaggcaggaagtgtcttcgggtagaactgagaatggggtctggagtggggcctaggctgggatgtggggatggtcagcaagtgaggcctggccaaccacctgtctcagtgagggcctgggagggggcgggaggccccagtaggagggtcaaggaccttgactggtgcagtcttgtgtccaagagaagggggtctggagtggggtaacggagggcaggccaggggcctatcagactgacgcctgtctggcctcagagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagtatgtgcacgagggaggcatagaggacctggtgaggcccctgctggccatcctcgacaggccggagaagctgctactgctgcaggacatcaggagtgtggtggcccccacagacctgggccgcttcgacagcatggtgatgcttgtggagctggaggcttttgaggccctcaagagcagggcagtccggcctcctgctttgagaccagcccggcaggacacgccacccaagcgtcaccttatcacccccgtgcctgccgcggaggcttctacctgctgccggtgaacggcttcccggaagaggaagataatggggagctgagggagcggctgggggccctcaaggtctccccaagtgcctctgcccctcgccacccccataaagggatcccccctctacaagacgtgccagtagatgccttcacccccctccgaattgcctgcacaccccctccccagctaccccccgtggctccccggcccctgcggcctaactggctgctgacagaacccctgagccgagagcaccctccgcagagccagatccggggccgggctcagagccgtagccgcagccgtagccgcagccgcagccgcagcagccggggtcaaggcaagtctccaggtagacgctccccatccccggtgcctacccctgcccccagcatgaccaatgggcgctaccacaagcctcggaaggccagaccccctctgccacgacctctggatggggaggcagccaaggtgggggccaagcaagggccctcggagagtggaactgaggggacggccaaggaggcagccatgaagaaccccagtggcgagctgaagacagtgacactgtccaagatgaagcagtccttaggtatcagcatttctgggggcattgagtccaaggtgcagcccatggtgaagatagagaagatcttccctgggggggccgctttcctcagtggggccctgcaggctggcttcgagcttgtggcagtggacggagagaatctagagcaggtgacccaccagcgtgcagtagacaccatccgtcgggcttatcgaaacaaggcccgggagcccatggagcttgtggtcagggtccccgggcccagcccacggccctcaccctctgactcatcagcccttactgatgggggccttcctgctgaccacttgcctgcccaccaaccccttgatgctgctccagttcctgcccactggctcccagaacctcccaccaatccccagactcctcccactgatgccaggctcctccagccaactcccagcccagccccctccccagccctccagactcctgattctaagcccgcaccctccccacgcatcccatgaccctccccctaacctcagattcacccactgactccagcatcccgttatccccaggacctctcctaccaacttcttcaggactctccagctcctgcccaccctgcctcctcccagtgccacactggtggctcacatctttccactttcttccctcctcagctgtcattaaggctctgccttagtgtccaaggacaaggtgctagtgggcagcctgtgtcacctgcactcactgctccccaacctcccaagccaggatagggggtgagaaagccaaggtctggagcttgggattggtgggcactttctcacatgctgtcccttatgagtcgcccaagcctccagggacacagactctcagacagggccctgaaggggtcaatgcatccattcctcaaccccaagcagcattctgtgcaaggaaacggatgaaaggcttttctagtccctgaaatcctgagagatcatttcacgttggggtccactaagacctcagacattctactggatttgtccttcctccatcaccttttctccccaagagagctctatgagggggaggagaatagccagcaaatggtgggggggggggggggtcaaacaagttcctgtactctttatccagcacattcacattatttttaaacaaaaaaattttttttaattttttctttgggtttgtacaagaaatttacagtgtgaaaaatatacaagtgaaaacgaggccataaacctgggtgaagggagaggctgcttggtcacaaacacaaataaacaagacatttctgagttcttcct

SEQ ID NO: 416007 - DNA, 2046 bp, Homo sapiens
ctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaagtgagggctgaggcaggaagtgtcttcgggtagaactgagaatggggtctggagtggggcctaggctgggatgtggggatggtcagcaagtgaggcctggccaaccacctgtctcagtgagggcctgggagggggcgggaggccccagtaggagggtcaaggaccttgactggtgcagtcttgtgtccaagagaagggggtctggagtggggtaacggagggcaggccaggggcctatcagactgacgcctgtctggcctcagagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcgccccctacagctcgggctccctgccgtcggaccgcatggacatctgcctcgggcaggaggagcccggcagccgcggcccaggctgggggcgggcggacacagccatgcagacggagcccgatgcgggaggccgggtggagacctggtgcagcgtgcggcccacagtcatcctcagggacaccgccatccgctcggacggcccccatcccggccgccgccttgactctgcgctctctgagtctcccaagacggctttgctgctggccctcagccgaccccggccccccatcacgcgctcccagagctatctgaccttgtgggaggagaagcagcagcggaagaaggagaagtcggggtcccctggggagaagggtgccctgcagcgctccaagacgctgatgaacctcttcttcaagggagggcggcaggggaggctagcgcgggacgggcgcagagaggcctggacactggacagcgggagcctggccaaaacttaccctcgcctggacatagagaaagcagggggcgtgggcccggtacagaagtttgtcacctggagactgag

SEQ ID NO: 416008 - DNA, 1579 bp, Homo sapiens
ctcgcctgcgggtggtttgacaaggctggcggcgccacaccagcgaccaggcctggagctcacacttctgagaggcatcgcaagcgagggccttcacgttactgagaccccagccccgcacagaggctcatggagctcgaagcacgcagggctggcctctccagagctagcagattccttctggacctgtagggtgccgccctagcccagccgccatggcgcagggtttcgcagtgggcttcgacccactgggcctaggagacctgagctccggctctctgagctccctctcctcccgaggccacctaggcagcgactcaggctccaccgcaacgcgatacctgctaaggaagcaacaacggctgctgaacgggcccccccgcggaatccgagcctcatcgcccatgggacgcgtcatcctcatcaactcccccatcgaagccaacagtgatgaaagtgacatcatccattcagtccgggtggagaagagtccagcagggaggctgggcttcagcgtgcgcgggggctcagagcatggcctgggcatcttcgtcagcaaagtggaggaaggcagcagtgcagagcgggctggcctgtgcgtgggggacaagatcacggaggtgaatgggctgagcctggagagcaccaccatgggtagcgccgtaaaggtgctgaccagcagcagccgcctgcacatgatggttcggcgcatgggccgtgtgccgggcatcaagttctccaaggagaagaccacgtgggtggatgtggtgaatcggcgcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaagtgagggctgaggcaggaagtgtcttcgggtagaactgagaatggggtctggagtggggcctaggctgggatgtggggatggtcagcaagtgaggcctggccaaccacctgtctcagtgagggcctgggagggggcgggaggccccagtaggagggtcaaggaccttgactggtgcagtcttgtgtccaagagaagggggtctggagtggggtaacggagggcaggccaggggcctatcagactgacgcctgtctggcctcagagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggagaccggccggtatcctgcctacaaggagatggtttctgagtactgctggctggaccgactgagcaacggggtgctgcagcagctgtccccggcctctgagagcagctccagcgtctcttcgtgcgcctccagcctgggccgcggctgccgggctcctcctgcccgaggcagatgtccatgcggtccgacggcagggagcccgagctgtagggggcgggcggacacaacgacg

SEQ ID NO: 416009 - DNA, 391 bp, Homo sapiens
gcatgggccgtgtgccgggcatcaagttctccaaggagaagaccacgtggtgagcagcaactccctcatcctagccctggccttgccccagcccaccccaaccctaccaacacccaaaacccactggcaggagaggcttctgttcctcctgctcgctggctcaggaaacgcaggggatccaaaggcctgacctcaaaataaggagaggctgcatctttcccctgccctcctccaatagctctgctctcccagatcccagtggttctgctgccacattgccgctgctcctgctgtgaaacccagaggcaaaacaccacctctctacaggggtgctgtaaggattagaaatggggcctagcctgggcaacatagcaagaccccttctctaaaa

SEQ ID NO: 416010 - DNA, 339 bp, Homo sapiens
tccggcctcctgctttgagaccagcccggcaggacacgccacccaagcgtcaccttatcacccccgtgcctggtcagtcagagtcccagagcccagggaggggcacagccctggggagattagggaaaggaggatgggccttctacttctttccccactaggggcagttgtggcttccaggcacattgtggttccctgaaggaaagctcttgtccaccagagccattttatcacatctgctggtcaccacctgtactattacttaatagttggtttgaaacccactcacttttaaaatctagtctcattctatgcagtaacctctgagaaattacgttt

SEQ ID NO: 416011 - DNA, 710 bp, Homo sapiens
catgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagcttctgaggctgtttaattccacccagcttgcagccatggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagggtttctatgtatttcccgggccagtggactatcgtgcgataacgggtgtgcggaagcactgggggggagcttgggtgctggctgctggcgggggttacccgacgttag

SEQ ID NO: 416012 - DNA, 452 bp, Homo sapiens
atggcaaaaccccgtctctactaaaaataaaaaaaatagctgcgcatggcatcacacgtctgtcatcccagctacttgggaggctgaggcatgagaattgcttgaacctgggaagtggaggttgcagtgagctgagattgcaccactgcactccattccaccttgggtgacagagccagactccatctaaaaaaaaattaagtcatccacaagtgtattttcttttcttataggaaaaacaattccaatagtttaaatcgaatgaatggtgttatgtttcctggaaattcaccaagctatactgagaggtgagattctagatttttaataacctacagagtttgcattgtcctgattttgagtagcaggcttagtgtactttttaaaaattgggcattttatgcaccccataggatgaactacatagaattagttcatttggtaaggcatgg

SEQ ID NO: 416013 - DNA, 283 bp, Homo sapiens
gtgattttagaaacaaaaatgatgaaactttatgttgtagtacttttcttcatactaaatcactgatttttgttattgcagaatgtgatggttgttagctgtgtttatccttcttcagataagtatattttttctatttctagtatattatttactatatttaatcattttattgcttctaatatattattcttaaaatagactgaatttatttaatatgtaattaagtgtgataacatacttgtgaacctaccattcagtccccaaagtagaatattactaa

SEQ ID NO: 416014 - DNA, 3376 bp, Homo sapiens
actgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcagtaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaa

SEQ ID NO: 416015 - DNA, 5722 bp, Homo sapiens
catgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagcttctgaggctgtttaattccacccagcttgcagccatggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggatattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaaggtatttagagaccatctgtaaaagggtggagtaaggagatcctcaaattcttgtacttcatttttttcgtgaaagaattttacgtaatggaactccttataatgctgatgttgggcttttctcccacctgtatgtagttgctgctgaatttcaggggatgtgatttgaactatagaatatcagaattcatgaaacttaactgtggaggtattttgaaaatacaatttaactacaacaacatttgcttatttttagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaattttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaagtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcctagattactttgccaaatgtattattttcataatgcaataaaatataaattagaata

SEQ ID NO: 416016 - DNA, 5753 bp, Homo sapiens
catgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagcttctgaggctgtttaattccacccagcttgcagccatggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggatattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggaaggccaaaaaatttttgcccccaggccaaaaaaaattggaagggaagaaaaaaaaaatcacagttgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaaggtatttagagaccatctgtaaaagggtggagtaaggagatcctcaaattcttgtacttcatttttttcgtgaaagaattttacgtaatggaactccttataatgctgatgttgggcttttctcccacctgtatgtagttgctgctgaatttcaggggatgtgatttgaactatagaatatcagaattcatgaaacttaactgtggaggtattttgaaaatacaatttaactacaacaacatttgcttatttttagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaattttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaagtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcctagattactttgccaaatgtattattttcataatgcaataaaatataaattagaata

SEQ ID NO: 416017 - DNA, 3696 bp, Homo sapiens
actgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcagtaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaaaaaaaaaaaaaaaaaaaaaaaaaaaaaaaaaaaaaaaaaaaaaaagaaaaaaaaaaaacaagaaaacccacacaaaaaaccaaccagtcaacagcagccaccacaaatgcactaaagacacccacgagctgcgccctacagatcggccgacctccacatgaacctccgcccctgacccaccacacacacctccgtccacccggccaaacccggcacgccgagcaaccggccccagacccctgatccaggcacctcatcccactcggccccaaaacacatctcccaactcaacagcccacacacacccccggcgacacgca

SEQ ID NO: 416018 - DNA, 1171 bp, Homo sapiens
gactgcctcggtgttgtagaagctggcgatcatccccaccatgtacgacaggctggcggtcaggaccgacagtgcaacaaggttccagggtgctttcgccggaagtccccacaacagctgaggtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaagtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcctagattactttgccaaatgtattattttcataatgcaataaaatataaattagaata

SEQ ID NO: 416019 - DNA, 1133 bp, Homo sapiens
tataacttgaatcctctagacgaaccgccaatataaacaaaatttaaggcccgcgtgcgacccatacttttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaagtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcctagattactttgccaaatgtattattttcataatgcaataaaatataaattagaata

SEQ ID NO: 416020 - DNA, 1268 bp, Homo sapiens
catgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagcttctgaggctgtttaattccacccagcttgcagccatggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggattttccctttcaagacaatctctttcaatccatgtattacccccttcagctgaagtttttggagactgtgcacactttatgtggacgaatcccgcaagtttttctgaagcaaattgagaaaacaatgaaaagggcttatgagaaacacgtcatcatccatgttggccccaaccagatgcactgaatattttgtcttgttgcaagtcaattaggtgtcttgtgaacaaggaaatactaatctctaagctgcctgggtctttttgtgtgaatatttaatggtgctccatgactgttgagttttaaaaacctcgttaaattttgccaaatcagttgcccccaaaagggaatatgcttttccttatttttttttctaaaatgctatttatctctaaggaaaaaaaaaaaagactattactcatttaacattgtttaagcaggttgagctagctgtgaaaatagcttttgtgagccttctaattccttaacgtctgagacca

SEQ ID NO: 416021 - DNA, 995 bp, Homo sapiens
  misc_feature (915)..(915): n is a, c, g, or t
  misc_feature (920)..(920): n is a, c, g, or t
  misc_feature (937)..(937): n is a, c, g, or t
actgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcagtaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaattatcccttttactattcagcgactatgtgaattgttaacagatccaaggagaaactatacaggaacagacaaatttctcagaggagtagaaaagaatgtgatggttgttagctgtgtttatccttcttcagaaaaaacatttccattngtttnaaatcgatgaatggtgntatgtttcctggaaattcaccagcctttcttataggcctaaatataatgggccctgga

SEQ ID NO: 416022 - DNA, 638 bp, Homo sapiens
agcatcgcaacttttaagtgtctcagtatgcctttttcagggctttgaagtcatctttccgcgccctaatttcgaggtggttgccttcactgttctgatgcacgccttccacgcaacaggcttgagaacagtgggcttacatacttagagtagagagatttcagcgttgtgagaattattctttgacattcagaatcatttggggacggcaacttggggtagttggtgcttcttagaaaggcagatttatggacttagatgaacaattggtgggagtcggggcctggggatttttattttcactggattcccagcttaatataatgctggtgttcccccggaccacacttcgagaagcactgcgttaaaaatggtttgtgaagttgagtgccccctttaggaggattcttgttatctgtaaagagggtgacatgttggaagtagaacttggaggattgaggtggtaatttggttgagaggccttatttttttaattttgtatttaattgatttttaataaggtaaaggactaggaggaaagtttgtttttagagcgcttttgagaaaactgataacgtttttttttcttccttcatctagattttgagaagagggggaaaaaggaagtttgtcctgtc

SEQ ID NO: 416023 - DNA, 438 bp, Homo sapiens
catttccgttactaaataaactttttttttgtcatctttcagtttccctttcaagacaatctctttcaatccatgtattacccccttcagctgaagtttttggagactgtgcacactttatgtggacgaatcccgcaagtttttctgaagcaaattgagaaaacaatgaaaagggcttatgagaaacacgtcatcatccatgttggccccaaccagatgcactgaatattttgtcttgttgcaagtcaattaggtgtcttgtgaacaaggaaatactaatctctaagctgcctgggtctttttgtgtgaatatttaatggtgctccatgactgttgagttttaaaaacctcgttaaattttgccaaatcagttgcccccaaaagggaatatgcttttccttatttttttttctaaaatgctatttatctctaaggaaa

SEQ ID NO: 416024 - DNA, 5380 bp, Homo sapiens
actgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcagtaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaattttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaagtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcctagattactttgccaaatgtattattttcataatgcaataaaatataaattagaata

SEQ ID NO: 416025 - DNA, 5467 bp, Homo sapiens
catgctcaaatcagctgtgctttttagccacaggaagatccaattccacatcttcactgaagactctctgaagcccgagtttgataagcagttacgccagtggcctgactcatatacaaagaagtttgagcacagaatctaccccatcacattttctgttggaaaccctcaggagtggaagaaattgttcaaaccctgtgctgcccagagactctttcttccggtgattttaaaggatgtggactcacttctctacgtggacaccgatgtcctctttctgagacctgttgatgacatctggaagcttctgaggctgtttaattccacccagcttgcagccatggcccctgagcacgaaatccccaagattggctggtacagccgctttgctaggcatcctttctatggctctgcaggagttaattcaggagtcatgttaatgaatttaactcggataagaagtacccagttcaagaacagcatgattccaacaggcctggcttgggaggacatgttgtaccctctgtaccagaagtacaagaatgccatcacgtggggagaccaggatttattaaatattattttttatttcaacccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggatattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaattttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaagtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcctagattactttgccaaatgtattattttcataatgcaataaaatataaattagaata

SEQ ID NO: 416026 - DNA, 5305 bp, Homo sapiens
actgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcagtaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaattttttcaaaaatgttaaaatgaggcaaatttaagtttacaaattttgaaattttcttttgaatatttatgaaattgtcagtaaacttacctaagatcctgtgaccttttgatattttttattttaattgtagtgccatggaccatttgtaaacaaattgatttacttttgttggttgtaagttgaagatttagcattatgactttgaggtctgtggttttatttgtaaacttgcaattgctatatttgcaagggcaaatgtatttctttattaaataaagtacaataatggtgaatgtaccaaaatgacatcacttaactctatgagagatctgcattttaatctatagtttaatagttttaatatttattagatattcatatgttgatcatagatcaaacttgttgctgtttatacagataattgtagaatgctcatggaatatctttagggtaggtggaatacttctgtagttaaattgggaaaccttgttcagctggttttagatattgatggccatttggaagtaaatttccgcaggtattcataggtgcacttaacacagactttgcttaatgaaaatgtcagttctaatagtaactgattcacttctgaacagaagtgattttaggcatatttcttaacatatatcaagcaaagtcctgttaaaagatctaaatgaagaatggagacctcagtgattaaagatattttgtttctgaccttgagcagattgcttacctgttctctagactataacccaacatgtaaaaaaaatttgaagatggtgatgaggaaagtgagatatatatatatatatgtattatgtttctagcacttttcccttttaaaaagtgaaaatatccttgtacatttttgaaaaatatattttcagttctgaaaaatgtagcagaagtagtgaaaatgtcatattttaaatgttgattattagataaatttaacctgcttagggtttattgtaactacacctttcagacgtgtgttttggagtagtggaattgccagccaggccctgtggcttggaaaggcatcccagaaatcctcggccagaaggtgtggcttgttaaagcattgagattcagagtattttgttttgccggtgtagataggcatgtatttatgcatttttgcatttgtaaaatcaacttttcaaataatgtaaatgtaatatactagtttacttaaaggtacttgggcagaatctaaagctgctacaatgtttgattatgaaaaaaatgtaacatggtaaggatgaaaatgcaacttacaaaaccaaaggaattaaaaattttcggtagtgtttcaaattgtcttctgaacaggaatttaacattggttttgatgaagtgagggtcagttctcaagatttgtgctaatcataaaatgaatgaatgcaaaacaccttgtaatttcatatggaattataaaaattaggtttgctgggttttggcctaataagagtgctagtatgtattggttagaatacatcttactatttcacattttaaaaatcagtacactcttcaggattttcttttatttcaacttggagcctagattactttgccaaatgtattattttcataatgcaataaaatataaattagaata

SEQ ID NO: 416027 - DNA, 3280 bp, Homo sapiens
actgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcagtaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctgtgtttatccttcttcagagaaaaacaattccaatagtttaaatcgaatgaatggtgttatgtttcctggaaattcaccaagctatactgagaggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctgaaggtagtgaaaacgaaggccctgtaagtagtagttcttctgactgccgtgaaacagaagaattagtaggatccaattccagtaaaactggagagattctttcagaatcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagcaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagatatagaagagtgcacttttggggtaccgagctcg

SEQ ID NO: 416028 - DNA, 1168 bp, Homo sapiens
  misc_feature (1088)..(1088): n is a, c, g, or t
  misc_feature (1093)..(1093): n is a, c, g, or t
  misc_feature (1110)..(1110): n is a, c, g, or t
actgtacaaatgctttatttctattcaatatttagaagacagttataaacaagatgcattcaatagcatggtggcagatgaacatcaggaaggaacatccatgagcttccatccacggaacctcaccatggatacgcttgtgatcaagggcctggtctcccctcaagacacggtcacagatcagaggccacaccatcctagcagtggagcagtaccagctgggacagggtccttctgtgacacctgctgcatcaccaggctgggtgaacggacacaattgccagaactcacagaatagaagtatcagcaccgaaacctcacaggaaaaatggtaagttctaagtttctccattaatagtaactctcagattaatctctgtcatccatcgcttctccaagaaatgactttttagggtgatgtgccaggcgccatgttggagggctggtggtagcggcttggggaggtgctcgctctgtcggtcttgctctctcgcacgcttcccccggctcccttcgtttcccccccccggtcgcctgcgtgccggagtgtgtgcgagggagggggagggcgtcgggggggtggggggaggcgttccggtccccaagagacccgcggagggaggcggaggctgtgagggactccgggaagccatggacgtcgagaggctccaggaggcgctgaaagattttgagaagagggggaaaaaggaagtttgtcctgtcctggatcagtttctttgtcatgtagccaagactggagaaacaatgattcagtggtcccaatttaaaggctattttattttcaaactggagaaagtgatggatgatttcagaacttcagctcctgagccaagaggtcctcccaaccctaatgtcgaatatattccctttgatgaaatgaaggaaagaatactgaaaattgtcactggatttaatggtatcccttttactattcagcgactatgtgaattgttaacagatccaaggagaaactatacaggaacagacaaatttctcagaggagtagaaaagaatgtgatggttgttagctggtgttattccttcttcaaagaaaaacatttccattngtttnaaatcgatgaatggtgntatgtttcctggaaattcaccagcctttcttataggcctaaatataatgggccctgga

SEQ ID NO: 416029 - DNA, 285 bp, Homo sapiens
gcaacagcctcctcgccgcctccacttcatcttctctgcatactgccagacttaatttttctaaaactacaccattcattcaacaacaaatatttgaatacctgctgtttgctaggactgaggttcatcaataagcaaaacacaccctgtggagtccacagttgggaagacaatcaaatagtcacatatagacagtgacaaacttaagtgctacatgaggaacacaaaacatgggaatctttgtagatcagggagggcttctggaaagaagcagcgtttaagctg

SEQ ID NO: 416030 - DNA, 794 bp, Homo sapiens
gaacggatatgcgcgttttcgtctgcgcatgtgcagtcaaccccactttccggcttctccctgttagtgtttgctggtgcagagggttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaagtgagttactgagcagtagtagacataattctgcaggagtggttagactccaggtcactttaggggtgaacacctaaatattgcaagacttttcttagaaagcctaaaggcacaaaaagcagcagttaaaagaaaataattaataaagttgattccattaaaagtaag

SEQ ID NO: 416031 - DNA, 452 bp, Homo sapiens
gctattttctacatcatctaattctgaacccttcagattgaatagaaatgtactgttacaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaagtgagttactgagcagtagtagacataattctgcaggagtggttagactccaggtcactttaggggtgaacacctaaatattgcaagacttttcttagaaagcctaaaggcacaaaaagcagcagttaaaagaaaataattaataaagttgattccattaaaagtaag

SEQ ID NO: 416032 - DNA, 5691 bp, Homo sapiens
gaacggatatgcgcgttttcgtctgcgcatgtgcagtcaaccccactttccggcttctccctgttagtgtttgctggtgcagagggttcgcagctcaggtgagagcgccgggcctccacgcggattgcggacctgcagggagggatgtgctagtgtccaggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctga

SEQ ID NO: 416033 - DNA, 5240 bp, Homo sapiens
gaacggatatgcgcgttttcgtctgcgcatgtgcagtcaaccccactttccggcttctccctgttagtgtttgctggtgcagagggttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctga

SEQ ID NO: 416034 - DNA, 5181 bp, Homo sapiens
gaacggatatgcgcgttttcgtctgcgcatgtgcagtcaaccccactttccggcttctccctgttagtgtttgctggtgcagagggttcgcagctcaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctga

SEQ ID NO: 416035 - DNA, 6010 bp, Homo sapiens
gaacggatatgcgcgttttcgtctgcgcatgtgcagtcaaccccactttccggcttctccctgttagtgtttgctggtgcagagggttcgcagctcaggtgagagcgccgggcctccacgcggattgcggacctgcagggagggatgtgctagtgtccaggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctgaaaaaaagacactgatgattgtcaccagcctgaatgattcttagggttgtgatgtaaccgattaactgtatactgggttgcccaccagcctgtgcgcgtccgaactcctcgcttccattggcacaaccgtggacacacacaaatggtcacgcgagactcgagttctctggcttcaggtcacctctatcaaattgcgctctcatggactcccgttccccaaatgcttccaatctacgatcgcacttgcaacttgggagccagttattctatcgaaatcccaggctcttcttcctgctcaggtcttgtctaccctacggggg

SEQ ID NO: 416036 - DNA, 6023 bp, Homo sapiens
gaacggatatgcgcgttttcgtctgcgcatgtgcagtcaaccccactttccggcttctccctgttagtgtttgctggtgcagagggttcgcagctcaggtgagagcgccgggcctccacgcggattgcggacctgcagggagggatgtgctagtgtccaggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaaaagattacagaggtgatgacctgatcaagcagaacaagaaaatcaaagacaaacacttggagcaagcaatatgtatcaataataaaacattgactacagaggaagagaaagttttggggaaaccatttactctgcatgtagctgctgttgcttcaacaaaaatgtcctgcaaatgcaactcatgggaagtgaatttgcaaagtatttctgaatttatcattaataatagaaactattcaacaaagaaaataggttgcggtaatgtatgtgagaattcacctttcaaaattaactttgagaaaactcagactggagagaaattttatgaacataataaaaacatgaaagctctcaattataatgaaaatcttcccaagcatccaaagtttcaaactttggagcaagcttttgaatgtaataaaattggaaaagcctttaatgataaggctaactgtgttaaacataacagttctcacacaggagaaacatcctctaaagatgatgaatttaggaaaaattgtgataagaaaactctctttgaccacaggagaactggcacagggaagaaacacctgcatcttaatcaatgtgggaaatcctttgagaagtcaactgtggaggaatataataaacttaatatgggtataaaacattatgaattaaatccaagtggaaataatttcaacagaaaggcacacctcactgatcctcaaacagctgtcatagaagagaacccattggtaagtaatgacagaacacagacttgggttaaatcctctgaatatcatgaaaataagaaatcctaccagacgtcggttcacagagttcgccgaagaagtcactcaatgatgaaaccctataaatgtaatgaatgtgggaaatccttctgtcagaaaggacatctcattcaacatcagagaactcacacaggagagaaaccatttgaatgtagtgaatgtggaaaaactttctcccagaagtcacacctcagtactcatcagagaattcatacagcagaaaaaccctataaatgtaatgaatgtggaaaaacatttgtccagaagtcaaccctcaggggacatcaaagaattcacacaggagaaaaaccctatgaatgtagtgaatgtgggaaaacttttgttcagaagtccaccctcagagatcatcacagaattcacacaggggagaaatcctttcaatgcaatcaatgtggaaaaacatttggccagaagtcaaacctcagaatacatcagagaactcacactggggagaaaacttaccagtgtaatgaatgtgaaaaatccttctggcgaaaagatcatctcattcaacatcagaaaactcacacgggagagaaaccattcaaatgtaacgaatgtgggaaaacttttgcccggacatcaaccctcagagtgcatcaaagaattcacactggggagaaaccatttaaatgtaatgaatgtgggaagaaatttgtccggaaagcaatccttagtgatcatcagagaattcacacaggggagaaaccctttcagtgtaataaatgtgggaaaacttttggccagaaatcaaacctcagaatacatcaaaggactcacagtggggagaaatcttatgaatgcaatgaatatgggaaattatgtaagaagtctaccctaagcttataccagaaaattcagggagaggggaatccctattgatgtaataactagaaaatccttttgacaaaaggaataccccatttgatatcagagatacacaaaaaaccaattgagggtagtgaatgtaagaagacagtcccagaagtaaaccctcactgtgaatcagagaattcacataggaaagaaaccagatgaagatgaatgcaggaagaattgtgtccaaaatgcaaccttcagagtgtatcaaagaattcagacaggcttctgttttcagagtactatggataggcctgaatgaagtcataccctattagatagctcccacacatcacacaggctggtaatctcttcaccagcaccaatttcattttactccaggcacatagtccagatttcccaatctccttttcatccaggttggtctttgtgactggctactaagatgtggatgtccatgatgtatatcacatcccagtctgaaacataagagacttccctaataaattaccagggccctgtcacaacaaaatggatatcatttctaggacaagcttggtgccgtgctttaatgtggcatggtacaagataaagaagtctgtgcctgaatgaatacacgcagcaaaattctcctcttctgtgtctttcccagttgaacattatgtgagcaaaatttaagcttatacagtagtccccccttatctgtattttcactttacgcaatttccattaaccatggtcaactgtactttaaagttattaaatggatccagaaataaacaattcctacattttaaactgcacccgattctgagtagtgggatgaagtctcatgccctcctgctctcccatgagggttattgaatcattccttagtctagcatatccacagtgtatacactatctgccagttagtcacttacttgacattttagttatcagatcacctgtcagggtatgacagtgcttgtattcaagtaacccttgttttactaaataatggcctgaaattgcaagagcatttctggcatgttgttgtaattattccattattagtccttaatttataaattaggcacagcaagagattaaactatcataggcatgtgtatatgtaggaaaaaaatatagtatatacagggttcagtatacccgtggtttcaaacatcaacttggaattcttggagagcattccttgtagttaagcagggactactgtattctgttgagctttcacatgtttgagtctatttgtttctacacataatttagttatcttctgctaggaaggcagaaagcttctgtgtaagccaggcttaagtcaatcagagggcacaaaccttattaggaggctagagagtcaaggagaacctcaaatatgatcagagaattgtggaaaagacatcctttcaatgtaatgaaattgatagtaccacctgatacagggctttgcatgaacctaaaagtcttttggctgaatggtgagcagccactgtgcagttcaacgtaagtgtgccttaattgcacagaggtactgcccccacacctcctgacacctccatataccccagctatatctgctttaaggagttttccctggctccaaaggccattggcacccacccaagtattatgggaaacctccagagaggggagggactcagatttatatggctttattgaatccatgcccaaggcaacatcttactagttcctgtgggggtacaggacacctagatttagctaatggggtttggcaatgggaaggcaaacaaatttaataactttatgggtgaggtactttgggccagtagagtatactacagttatgtttacatctgaaagtgtagtagggattaattcccataagttatagagagaattctaattccctgtaattcgcataagtcatagaattctaatcaggaataattgtatgtaaagatacctctgaggtccaacagctctgatcattttgggcttcaagtctctctctgtgactggtgattttgtgggttgaaacttctggcaaaagggggcagcccttgggagctgggggccaggggattgacttggttccctgacaagggtaccaggtccaccccttctgaaaagcagctgttagtttactcttgggctcttttacacattggatatctcttccttgggtagagggttctgacctaaaattccactttaggagtttgtcgtcttggactcaacaactaacaaaatgaaaaggacccagcaagcctcacttgtggaatgaaaatggggcattcaggaaagcacctgtcctggccccacagtatgtcagctgtataggcaatagtagtagctgtctcttagaagggaaataatgtatcacctctttccagaacgaagcaaagttgctggcttagtagagccctcaattcatagaggttactgtaattgggcctggctcactgatgctttcgccaactgaaactactaggatcctgtgtgtgttcaaactcagtgccattaacaaacccaaagtgaagcggtcactcctctcagtggaaagagcacgaggatgttctcagctctggccaatactccatttcataaaccatgttacatttttgttaagccttggctctggatgtggcctagatatttgatattctaattggaaattacagattaaaaagcaccctttctttgtacagtgggggtaaaagtcacagctgcttagtacaaccatctgggttgctcaagtagatgcccataataagagactattttctgataagactgactggaatcaagctgccgacagctttctccatccagattgtgacggttgctacctggatccatcattttactggtatggcaaaaaatcacccatgtgacactgggtgacatggtaaaagtacatggtacttttacagtaccatgtactgtacaaaataaaggtctctttatctgaaaaaaatctcttcttcttagccctcctctccttcaattccagtggggtcctcttcccgcctctctccctatctcttctttcatcactctcccgcgcttcgcccaatcgctcccctctgtcacacctctgtcctctcctactcctgccgttccgcattaccttaccactctctctcctcttctttcctctacgagctctcctactttctctccttcaattgtattgcttcttcttatccttctctcacatccgacggcttattttttctcttaaccctctcttcttcacacttctccgctcctcttccctctcttcccagttcgcgattccct

SEQ ID NO: 416037 - DNA, 1245 bp, Homo sapiens
gaacggatatgcgcgttttcgtctgcgcatgtgcagtcaaccccactttccggcttctccctgttagtgtttgctggtgcagagggttcgcagctcaggtgagagcgccgggcctccacgcggattgcggacctgcagggagggatgtgctagtgtccaggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggaaggagggagccccaggaacaggagtcccaccgaagaactgctctctgacagaacagagacctcctcaccagggcttccaaacagatgcagaagaacccagaaaggagcaggtcttgatttgcccaaccagcggcacttcttcatccccttgcccagagagcaccagacttggtgatgtcgccacatccagaagccatcacagattgtgtgacactgaacactgtgggccaacttgcagaaggtggttatcctttacggttctccacactctttcaggagcagcagaaaatgaacatatctcaggcatcagtgtcattcaaggacgtgactatagaattcacccaggaggagtggcagcaaatggcccctgttcagaagaatctgtacagagatgtgatgctggagaactacagcaacctcgtctcagtggggtactgctgtttcaaaccagaggtgatcttcaagttggagcaaggagaggagccttggttctcagaggaggaattctcaaaccagagtcacccaagtgagttactgagcagtagtagacataattctgcaggagtggttagactccaggtcactttaggggtgaacacctaaatattgcaagacttttcttagaaagcctaaaggcacaaaaagcagcagttaaaagaaaataattaataaagttgattccattaaaagtaag

SEQ ID NO: 416038 - DNA, 915 bp, Homo sapiens
gaacggatatgcgcgttttcgtctgcgcatgtgcagtcaaccccactttccggcttctccctgttagtgtttgctggtgcagagggttcgcagctcaggtgagagcgccgggcctccacgcggattgcggacctgcagggagggatgtgctagtgtccaggggcgggaacgcgacgtcccgggaactcccccaaagcaggccgtcgctccctgtgcctcggccggcccgggacctcagcctgagaagggccggtgggggcgggctccgggggcgttaggtggggctgagtcctagttggaagatgctcggtgcgggccgaggtatgggcgccagaatgcagccaggcgtcggaaaacgcggtgctggcttcaggaggggaatgcgcgtttattgtattgaccatgaacctgccacaaagcgcgtacagcccgtgggtctgcggtgagaggccgagcctaggagctagaaggacctcgtgaattttggctctgtcacttgagcgtttgaaaatgaggatattagtaaaaactgctttgtgtcgttcagaggtaagccatcccctgtaaagcatttagctaagcgctagttactaagcagcatgtaaatgttgattcccgttatatttggaagacactttgttcttttcatgtagtatttcgtttaattctcacaaccaccctatttatatcattaaaaatgaagaaggaggagtgaaaagatagagccaagctcacaaaggatgagagagctaggatgtcaatacataaacactttactccccgaatcaggctgtttgtaatggcctacctacctaacccagcattgcagccttcacagcactgagtgattgtccccaaaaccccaggacaatgattgtgaagtcagtgtggacagaatcttactatgtggcaagt

SEQ ID NO: 416039 - DNA, 418 bp, Homo sapiens
gaggatgaaggaaggccccgcccatgagcacatcctcttgcaattcatcaacactgaaaataaagataccataaagaaatgtgaagcaggctgggcgcagtggtgcatgcctgtaatcccagctacttgggaggctgaagcaggagaatcgcttgaacccaggaggcagaggttgcagtgacctgagatcaggccactgcactccagccttggcgacagagagtccgtcgcaaaagaaaaaaacaaacaaacaaacaaaaactaagagcttttgtaaagaatagcttcaggccaggcgcagtggctcacgcctgtaatcccagcactttcggaggccaaggcgggcggatcacgaggtcaggagttcgagaccagcctgaccaacatggtgaaaccctgtctctactaaaaatacaaa

SEQ ID NO: 416040 - DNA, 713 bp, Homo sapiens
caacaagtgggggtttatgaaaaactttcaggaatgggttatctatggtggccgtggagctggcttcctcaagggctctttgaccacaggaagcttggtagcaacaattttaaggtgaacctgccagaggcaagatgagtaagtagctgtggattcatttagtttctgcatccctccagcatgaccgtgagtagcacagccgtggtgccagcctcctgagtttaccatctcatcagaggctagctacacactaggagttactgaccatttctacatgccggagactgtgctacatctcttatagacatgacttcacttactcctcacccaggaacactgaaggaaggacaattacccaatcttcaaaacataaaacaggctcaggctaagcatcttcctccaagttacaccactgacaagtggtagagccaggatttgaactcagagctctataatcaaagcctgctgtcttatccatgatcttgccatccaaacccaaaaacaaatgacctaggccgggcgcggtggctcacgcctgtaatcccagcactttgggaggccaaggtggacggatcacgaggtcaggagatcgagaccatcctggctaaaatggtgaaaccctgtctctactaaaaatacaaaaaaattagccgggcgtggtggcgggcgcctgtagtcccagctactcgggaggctgaggcaggagaatggcg

SEQ ID NO: 416041 - DNA, 1182 bp, Homo sapiens
caacaagtgggggtttatgaaaaactttcaggaatgggttatctatggtggccgtggagctggcttcctcaagggctctttgaccacaggaagcttggtagcaacaattttaaggtgaacctgccagaggcaagatgagtaagtagctgtggattcatttagtttctgcatccctccagcatgaccgtgagtagcacagccgtggtgccagcctcctgagtttaccatctcatcagaggctagctacacactaggagttactgaccatttctacatgccggagactgtgctacatctcttatagacatgacttcacttactcctcacccaggaacactgaaggaaggacaattacccaatcttcaaaacataaaacaggctcaggctaagcatcttcctccaagttacaccactgacaagtggtagagccaggatttgaactcagagctctataatcaaagcctgctgtcttatccatgatcttgccatccaaacccaaaaacaaatgacctaggccgggcgcggtggctcacgcctgtaatcccagcactttgggaggccaaggtggacggatcacgaggtcaggagctcgagaccagcctagccaacatagtaaaaccccatctctactaaaaatacaaaaaaaattagctagtgtagtggcgggcgcctgtaatcccggatactttgaaaattacatacaaaaattactaagaggcccaggcacagtgtcttatgcctgtaatcccaacaccttgggaggccaaggcaggcggatcccctgaggttggaagttcgagaccagcctgaccaataaagtgaaacgccatctctactaaaaatacaaaaattagctgggtgtggtggcaggcgcctgtaatcccagctacttgggaggctgaagcaggagaatcgcttgaacccaggaggcagaggttgcagtgacctgagatcaggccactgcactccagccttggcgacagagagtccgtcgcaaaagaaaaaaacaaacaaacaaacaaaaactaagagcttttgtaaagaatagcttcaggccaggcgcagtggctcacgcctgtaatcccagcactttcggaggccaaggcgggcggatcacgaggtcaggagttcgagaccagcctgaccaacatggtgaaaccctgtctctactaaaaatacaaa

SEQ ID NO: 416042 - DNA, 1760 bp, Homo sapiens
aatccttagatttcttggattgggttttgacttttctcctgaatctcgatgatttttgttcctatccatattctgaattctacttctgtcatttcagccatttcagcctggttaagaacccttgctggggcactagggtggttgtttggaggaagagactctggcttttcaagtagctatatagcaatgctccactcctcagtaccaattttctgtggcaggccatccttatattgcaaaaaatacctgaggctgggtaatatataaagaagcttaattggcttatggttctataggctgtacaagcagcacagtcccaggcatctgctcagcttctggtgaggcctcggaaagcttacaatcatggtggaaggcaaaggaacccgatgtctcacatagtgagaatcaagagtaagagagagtgaaggaagaagccatatacttgtaaacaggcaaacctcatgagcacgcaccatcacaaggacagcatcaagtggatggggctaaaccattcatgagaaatctgcaccaatgatgcagtcacctcctaccaggttccacctccagcactggaaattacaattcaacaagagagttagaggggtcaacttccaaactatatcattctccctgcagttctatcagtttttgcctcatgtatcctgatcctctgttcttgggtgcatacatgttaaggatagtcatgtcttcttggagaatggacccctttcatcattatccctgatagtaattcttgctgtatagtctgctattctataatatacctatttcttcattttggttagtgttagcctggcatatttttctctctttaatttgtatgtctctttacatttcaagtgggttgcttgtaaccaacatataattgggttttgttctttgatcctgctttgacaattttttcttttttaaactggcccagtttttccatataataatctatcttttaattggtacatttacacccttgacattcaaagtatttatatatttggataaacatctaccataatgttactgttttctatttgttaaccttgttctttattcctatttttgtcttccattcgtcttgtgcctttgatggtgttaatttggcattttattattctctcttctagcgtggttttcttgtggttgcccttgtgtttgcagtatagatttacaaataatgcaacccctctttcaaataataatatactgcttcttgggcagtgtaccttatagtaacaaaataatcctaatttctctttcctatcccatgtatcattgctgtcattccacttatatataagcacccctaagtatgacgactatacacacacacacacacacacacacacacaaatatatgtgtacaaaatcaaatacattgttgccattattttgaatgaactgttaactgttagattaagaattggtaccatatggaacaggttagtggaacttactataaaaggcttttctttgggggaaatttttaattactgaaactatttaggagctgtgggattacatgtctatcttcaattagtttgagtaaaatactcgtagtaatttgtgtattttgtcagttttcaaatgaattgttcataatatcctcacattttcaaatttcaactgcgtttataaaattttcatttttccattctctatttgtgtcttcttgctcgatcttaccaaaatattttgttttagtgctttttcaataaacaagttctggcttattttacttggtt

SEQ ID NO: 416043 - DNA, 1656 bp, Homo sapiens
aatccttagatttcttggattgggttttgacttttctcctgaatctcgatgatttttgttcctatccatattctgaattctacttctgtcatttcagccatttcagcctggttaagaacccttgctggggcactagggtggttgtttggaggaagagactctggcttttcaagtagctatatagcaatgctccactcctcagtaccaattttctgtggcaggccatccttatattgcaaaaaatacctgaggctgggtaatatataaagaagcttaattggcttatggttctataggctgtacaagcagcacagtcccaggcatctgctcagcttctggtgaggcctcggaaagcttacaatcatggtggaaggcaaaggaacccgatgtctcacatagtgagaatcaagagtaagagagagtgaaggaagaagccatatacttgtaaacaggcaaacctcatgagcacgcaccatcacaaggacagcatcaagtggatggggctaaaccattcatgagaaatctgcaccaatgatgcagtcacctcctaccaggttccacctccagcactggaaattacaattcaacaagagagttagaggggtcaacttccaaactatatcattctccctgcagttctatcagtttttgcctcatgtatcctgatcctctgttcttgggtgcatacatgttaaggatagtcatgtcttcttggagaatggacccctttcatcattatccctgatagtaattcttgctgtatagtctgctattctataatatacctatttcttcattttggttagtgttagcctggcatatttttctctctttaatttgtatgtctctttacatttcaagtgggttgcttgtaaccaacatataattgggttttgttctttgatcctgctttgacaattttttcttttttaaactggcccagtttttccatataataatctatcttttaattggtacatttacacccttgacattcaaagtatttatatatttggataaacatctaccataatgttactgttttctatttgttaaccttgttctttattcctatttttgtcttccattcgtcttgtgcctttgatggtgttaatttggcattttattattctctcttctagcgtggttttcttgtggttgcccttgtgtttgcagtatagatttacaaataatgcaacccctctttcaaataataatatactgcttcttgggcagtgtaccttatagtaacaaaataatcctaatttctctttcctatcccatgtatcattgctgtcattccacttatatataagcacccctaagtatgacgactatacacacacacacacacacacacacacacaaatatatgtgtacaaaatcaaatacattgttgccattattttgaatgaactgttaactgttagattaagaattggtaccatatggaacaggttagtggaacttactataaaaggcttttctttgggggaaatttttaattactgaaactatttaggagctgtgggattacacgtgcgcgagggataacacgtgcgcgaggataacacgttcgcgagagataacacgtgcgcgagggataacacgttcgcgaggggataacacgtgcgcgagggataacacgttcgcgag

SEQ ID NO: 416044 - DNA, 826 bp, Homo sapiens
tggctgccaagggaaaccctacagtcagaaagtactagaattgttactatctacagggaatcactttctattttttgagttctcaacttcacctcctcctttcaatagtgcccctccatattgctaatctgagaattagtctgaatatgaaaacttttgaaaatatgtttgtgttgtccaagaaaaatttcaccagtgtttctggttgcctgctggttttcagcctttatcttgagtgggcatgtttattctaactgaatgaagaatgactattgaattaggtatattccccatgccaaataattttaactgtgatgtaatcctagccgctttcttatttttactcccgaataaatttaaaatatttaagattggccaggtgtctgtttttctcagggtaacatgggacagctatggataggcattaggcctctcatagaactcttcattcaagtgagtgtggctgagaggaacaaccaggaaagagtatagtgccccattgcacttgccctgttggcttttcaaatgcaaaatccacgttgttgcatttgggaaacttgtttctctgttttatggtatttcatttaagaattttttttaactgccagtctgtaaatatttaaccagccaagcaggaaacagccttttattctcgactgtatacagcttttgtttttatctgggttagcatgggtgccatgtaaataccatataaaatttgactttggttgtccttactttgaagattgacaggggtttctttaattaatcttgtttcctttcatgttctgtattgagatattgaaatacagtattttatacattt

SEQ ID NO: 416045 - DNA, 4100 bp, Homo sapiens
atactgcatacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagcttcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaa

SEQ ID NO: 416046 - DNA, 2671 bp, Homo sapiens
atactgcatacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagcttcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgta

SEQ ID NO: 416047 - DNA, 3821 bp, Homo sapiens
atactgcatacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagcttcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaa

SEQ ID NO: 416048 - DNA, 2515 bp, Homo sapiens
gcgctgatgtcggcgttctgcttgtcctccagctcctgcagctgcttctccagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaa

SEQ ID NO: 416049 - DNA, 1398 bp, Homo sapiens
tagcgtggtcgcggccgaggtacgcgtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaa

SEQ ID NO: 416050 - DNA, 4046 bp, Homo sapiens
atactgcatacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagcttcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattatgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaa

SEQ ID NO: 416051 - DNA, 4052 bp, Homo sapiens
atactgcatacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagcttcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaa

SEQ ID NO: 416052 - DNA, 3517 bp, Homo sapiens
atactgcatacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagcttcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccaggtctttggccgatctgcctacggcggtttacagaccagctcctatctgatgtccacccgctccttcccgtcctactacaccagccatgtccaagaggagcagatcgaagtggaggaaaccattgaggctgccaaggctgaggaagccaaggatgagcccccctctgaaggagaagccgaggaggaggagaaggacaaggaagaggccgaggaagaggaggcagctgaagaggaagaagctgccaaggaagagtctgaagaagcaaaagaagaagaagaaggaggtgaaggtgaagaaggagaggaaaccaaagaagctgaagaggaggagaagaaagttgaaggtgctggggaggaacaagcagctaagaagaaagattgaacccccatttccttaattatttcaggaataattctcccgaaatcaggtcaaccccatcaccaaccaaccaaccagttgagttccagattctatgtgaattaaaaagtcaatatatgtataattctgagatgacttaggttggacattcaatgttgtgctatgaatttcctctttatgcagagtatctgtttgcttgcagagtggctttctggcttgctgccagcctgtgcatggtccacgcttatgagttcaggatctacggcaatgtgaatcattcagatgtttacaataaaaaacaccacatgagtaaatgaattcactaatgttaatgttaaacttcatggaaaaatagtcctttgaaccttcggtggttagcaattaaagaccctgagttatgtgcaataaatagtaaataaagttataccgaatgatgtattttttgctgtggttgttacttaattaaaataccttaaagatggcaccaatataaagtatataccagtggactattgacctccaattttttaaaaagttgaaattttaacaattaccaatacttttttttcttccttcaattggaaattctgagggatacagttatgtcatgattacttgtgaaatctctccccacaaaaattttactgataataaacatgagtaaatgagaaagtctataaataacaatagactttgcctcataacacgtgttgtgttaggttttgggatggctttctagggagcaattctgaaattacttgacagatacactctttatggtaaacaggtcatttcagagtctagagtgctaaccattacactatggaaccatgataaataggtcatttcaaactgatatgtcacaatgcaatatggatagaatatgaatcccatacattcatccctataactgcattttaaaatatagtctaaatatcatgggaggaggttaaaacctgagaacatggtacaataagaaggaataattttttatctatatataatttcaggagaagggattaaaactaccaaaggttatttgccactccactgcaaacatgttgcctgcaatcctgagctcatgatttagtgtgttgttaagcgtaattctgttgcctcaagtaaataccacttaatgctacacatttttaaacctttaaaagctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctcttgcatttgatgtggaataaatatagatgatattactatctgctattctgcctttgttctgaaacaattgctttgtcagctaatttcattcaatatttgttttttagacgatctctataagttattaatttaacctgaaaccaaagtggtctccatttaaagttacttaatccctttgtaccacctatttctagttaaatatatgttgctatgcaaataggtaaagtgcttccttgccatgatggtaatggattggaactatgaaggctctcagtgtattggcttctgtaaagatgaggcgtctcctcagaaacaaaacttttcacatttctgcttactagacctgggttgatgtacatggtaagtctcaaacagatgcaagctatgtgcaaaaagtaactttagccaaatggaaatagctggatgctttgagaattacttggttgaagtaagaaaactgtaccatcctctatcctgtgtgccataataaaatagtaaaaaacctaaaaaaaaaaaa

SEQ ID NO: 416053 - DNA, 1884 bp, Homo sapiens
atactgcatacacataacctagcctatttatttgtatctaaaattccctagccgcaccatcaccgtaaacaccaagggaaaaaattaaggaggttcctggtgggaaaagggcgagttggggggacagggtgtctgcgaggtgacgggatacagaaaactagggtgtcaaaagggagcaagaacctgttttgggggcaacttaaggatccaagtgtcacggggtctgggcaatgcaggacgggaggggctgcgtgagtgagtacagaagggaaatgagtgagggggcatgggatctcagagaaaatcagggccctctgagcaaagtggaaaggacgaccgccgcagctcctcgggccgtagcttcgaccccgccttcccttttgcgcagaatcctcgccttggctgcagcagcgcgctgcccccactggacggcgtgccgtgatcgatcgcaggctgcgtcaggagcctcccggcgtataaataggggtggcagaacggcgccgagccgcacacagccatccatcctcccccttccctctctcccctgtcctctctctccgggctcccaccgccgccgcgggccggggagccaccggccgccaccatgagttccttcagctacgagccgtactactcgacctcctacaagcggcgctacgtggagacgccccgggtgcacatctccagcgtgcgcagcggctacagcaccgcacgctcagcttactccagctactcggcgccggtgtcttcctcgctgtccgtgcgccgcagctactcctccagctctggatcgttgatgcccagtctggagaacctcgacctgagccaggtagccgccatcagcaacgacctcaagtccatccgcacgcaggagaaggcgcagctccaggacctcaatgaccgcttcgccagcttcatcgagcgcgtgcacgagctggagcagcagaacaaggtcctggaagccgagctgctggtgctgcgccagaagcactccgagccatcccgcttccgggcgctgtacgagcaggagatccgcgacctgcgcctggcggcggaagatgccaccaacgagaagcaggcgctccagggcgagcgcgaagggctggaggagaccctgcgcaacctgcaggcgcgctatgaagaggaggtgctgagccgcgaggacgccgagggccggctgatggaagcgcgcaaaggcgccgacgaggcggcgctcgctcgcgccgagctcgagaagcgcatcgacagcttgatggacgaaatctcttttctgaagaaagtgcacgaagaggagatcgccgaactgcaggcgcagatccagtacgcgcagatctccgtggagatggacgtgaccaagcccgacctttccgccgcgctcaaggacatccgcgcgcagtacgagaagctggccgccaagaacatgcagaacgctgaggaatggttcaagagccgcttcaccgtgctgaccgagagcgccgccaagaacaccgacgccgtgcgcgccgccaaggacgaggtgtccgagagccgtcgtctgctcaaggccaagaccctggaaatcgaagcatgccggggcatgaatgaagcgctggagaagcagctgcaggagctggaggacaagcagaacgccgacatcagcgctatgcaggacacgatcaacaaattagaaaatgaattgaggaccacaaagagtgaaatggcacgatacctaaaagaataccaagacctcctcaacgtgaagatggctttggatattgagattgcagcttacaggaaactcttggaaggcgaggagacccgactcagtttcaccagcgtgggaagcataaccagtggctactcccagagctcccagtatgccagaagtccagatgccggccggcc

SEQ ID NO: 416054 - DNA, 1884 bp, Homo sapiens
gtgcgggatcggaagttccatttttcagatgggaaaagtgaggctcagagaaaggaatctggaacgatgaaggtgatgattgtgcctgtggccaagaccgggagaaccctggatccctacaccttccccacccctggaatgtcactatacatatctgacttcttctgatgttgcctttgaccctaaagtcaatatgataaagtaacaagaagctgggacagaggaacaaacacagcccactcaagcagtggtggcaacattctgttagaaaggaggggagtcaaagaaaaaaacacccctccgcccatctccttatcacctccctaaagacagaggagaacatggacaccctccatcctgatagacatgccatgtggtcagtttgtgcggtaaacaggaaaaaaaaaaacctaaagatattgtagacctttattttctttaaatctcctaataaaaacattaaactttcaagaagattccaaactgacattgcatagaccaactcctttccaaaaatatctctgatatactctccaactctctcaatatatagaatttgaagtccaggagctgtgggcacctggtgggaattcactgagctcaaggggacaagagggctgaggacagggctcccacatggggacaaggccaggctttctggcctctggttccagccagcatcaatttggttgtggccaaattctcagtccaatcaccctggcccagggcctggcgtgggaggatgtggcaggctctgtctccttctggggttcctggtctggaggagtctccccaacagcgccaaagctggctgttttccgcccaaagccccagaactttgaatgagaggcaaatctaccctgaatgcacctccctcctaggctgggtgaggtcacgcagacacagaagggcaggacagaactccccatcttctgggggccaattcgtctggacactgtgcggtcagcttcctttttaaagtgccagtatcggtggggcaggaagggactctcagggctgagcagagccttctccagcgcgagcaaacactctgtcccgcctcggcaggcaccttctaacattcattttctaagggttaggtgagtaaaacaacaacaacaaatgctggaaatgctctgttcccaatgccagggagttccaagaccaagaagcccaactctcaccagcgggggcagatggggagctagggaaggaaccctcccagcctggggagggcacctgcacccctcccagagagagaagcccccatcccggccccccagctgggccccagcgctgctggaaccagccggcaggtggggcagaaaagcagcacctcccctcaccagggcgaggaggcaatattgaaccgtgaactcaagaagaaagacggaaagaaaaaatgaaaaaagctacagggctaagtaaacaccagcctgctgggtttatacaaaatgagtgaaatttaaaaggggcaggagagtttgtccagggactggctggcagccagaacccaccttcaagcaagttacaaggacttgggggaaagtgctgagagcagaggctttagtagggggcagggccagactgctccccactgggaaagcacaccccttaaaggagcccttcccccttgcccagaacgggggatgcttccagaggaaggctgaggcttttctggtaaggaagccagctccggaccagtccagccacagcccacctgcctctctggcatccgccccagtctgggcagctgaccctgagggcagagaaggactttgcttgctccaaccttcctgcaggaaaaccagctgctcaggacccagccctgggcagagggcacggtcggtgctcagacctttctcagcacgggtctcagacctg

SEQ ID NO: 416055 - DNA, 1942 bp, Homo sapiens
cacttgattgcagagaaggtctacagagcagtggttagaacttggccctgaggacagagcttttgctccgtatgaggctggcaggtaacgatcttctcagttttctccccaggaatctggaacgatgaaggtgatgattgtgcctgtggccaagaccgggagaaccctggatccctacaccttccccacccctggaatgtcactatacatatctgacttcttctgatgttgcctttgaccctaaagtcaatatgataaagtaacaagaagctgggacagaggaacaaacacagcccactcaagcagtggtggcaacattctgttagaaaggaggggagtcaaagaaaaaaacacccctccgcccatctccttatcacctccctaaagacagaggagaacatggacaccctccatcctgatagacatgccatgtggtcagtttgtgcggtaaacaggaaaaaaaaaaacctaaagatattgtagacctttattttctttaaatctcctaataaaaacattaaactttcaagaagattccaaactgacattgcatagaccaactcctttccaaaaatatctctgatatactctccaactctctcaatatatagaatttgaagtccaggagctgtgggcacctggtgggaattcactgagctcaaggggacaagagggctgaggacagggctcccacatggggacaaggccaggctttctggcctctggttccagccagcatcaatttggttgtggccaaattctcagtccaatcaccctggcccagggcctggcgtgggaggatgtggcaggctctgtctccttctggggttcctggtctggaggagtctccccaacagcgccaaagctggctgttttccgcccaaagccccagaactttgaatgagaggcaaatctaccctgaatgcacctccctcctaggctgggtgaggtcacgcagacacagaagggcaggacagaactccccatcttctgggggccaattcgtctggacactgtgcggtcagcttcctttttaaagtgccagtatcggtggggcaggaagggactctcagggctgagcagagccttctccagcgcgagcaaacactctgtcccgcctcggcaggcaccttctaacattcattttctaagggttaggtgagtaaaacaacaacaacaaatgctggaaatgctctgttcccaatgccagggagttccaagaccaagaagcccaactctcaccagcgggggcagatggggagctagggaaggaaccctcccagcctggggagggcacctgcacccctcccagagagagaagcccccatcccggccccccagctgggccccagcgctgctggaaccagccggcaggtggggcagaaaagcagcacctcccctcaccagggcgaggaggcaatattgaaccgtgaactcaagaagaaagacggaaagaaaaaatgaaaaaagctacagggctaagtaaacaccagcctgctgggtttatacaaaatgagtgaaatttaaaaggggcaggagagtttgtccagggactggctggcagccagaacccaccttcaagcaagttacaaggacttgggggaaagtgctgagagcagaggctttagtagggggcagggccagactgctccccactgggaaagcacaccccttaaaggagcccttcccccttgcccagaacgggggatgcttccagaggaaggctgaggcttttctggtaaggaagccagctccggaccagtccagccacagcccacctgcctctctggcatccgccccagtctgggcagctgaccctgagggcagagaaggactttgcttgctccaaccttcctgcaggaaaaccagctgctcaggacccagccctgggcagagggcacggtcggtgctcagacctttctcagcacgggtctcagacctg

SEQ ID NO: 416056 - DNA, 1830 bp, Homo sapiens
gtgcgggatcggaagttccatttttcagatgggaaaagtgaggctcagagaaaggaatctggaacgatgaaggtgatgattgtgcctgtggccaagaccgggagaaccctggatccctacaccttccccacccctggaatgtcactatacatatctgacttcttctgatgttgcctttgaccctaaagtcaatatgataaagtaacaagaagctgggacagaggaacaaacacagcccactcaagcagtggtggcaacattctgttagaaaggaggggagtcaaagaaaaaaacacccctccgcccatctccttatcacctccctaaagacagaggagaacatggacaccctccatcctgatagacatgccatgtggtcagtttgtgcggtaaacaggaaaaaaaaaaacctaaagatattgtagacctttattttctttaaatctcctaataaaaacattaaactttcaagaagattccaaactgacattgcatagaccaactcctttccaggagctgtgggcacctggtgggaattcactgagctcaaggggacaagagggctgaggacagggctcccacatggggacaaggccaggctttctggcctctggttccagccagcatcaatttggttgtggccaaattctcagtccaatcaccctggcccagggcctggcgtgggaggatgtggcaggctctgtctccttctggggttcctggtctggaggagtctccccaacagcgccaaagctggctgttttccgcccaaagccccagaactttgaatgagaggcaaatctaccctgaatgcacctccctcctaggctgggtgaggtcacgcagacacagaagggcaggacagaactccccatcttctgggggccaattcgtctggacactgtgcggtcagcttcctttttaaagtgccagtatcggtggggcaggaagggactctcagggctgagcagagccttctccagcgcgagcaaacactctgtcccgcctcggcaggcaccttctaacattcattttctaagggttaggtgagtaaaacaacaacaacaaatgctggaaatgctctgttcccaatgccagggagttccaagaccaagaagcccaactctcaccagcgggggcagatggggagctagggaaggaaccctcccagcctggggagggcacctgcacccctcccagagagagaagcccccatcccggccccccagctgggccccagcgctgctggaaccagccggcaggtggggcagaaaagcagcacctcccctcaccagggcgaggaggcaatattgaaccgtgaactcaagaagaaagacggaaagaaaaaatgaaaaaagctacagggctaagtaaacaccagcctgctgggtttatacaaaatgagtgaaatttaaaaggggcaggagagtttgtccagggactggctggcagccagaacccaccttcaagcaagttacaaggacttgggggaaagtgctgagagcagaggctttagtagggggcagggccagactgctccccactgggaaagcacaccccttaaaggagcccttcccccttgcccagaacgggggatgcttccagaggaaggctgaggcttttctggtaaggaagccagctccggaccagtccagccacagcccacctgcctctctggcatccgccccagtctgggcagctgaccctgagggcagagaaggactttgcttgctccaaccttcctgcaggaaaaccagctgctcaggacccagccctgggcagagggcacggtcggtgctcagacctttctcagcacgggtctcagacctg

SEQ ID NO: 416057 - DNA, 528 bp, Homo sapiens
gaatctggaacgatgaaggtgatgattgtgcctgtggccaagaccgggagaaccctggatccctacaccttccccacccctggaatgtcactatacatatctgacttcttctgatgttgcctttgaccctaaagtcaatatgataaagtaacaaggtaaaaacaaaacagcaaaagaaacaaaaaccgaaacatttaattttttctccccaaaccaagacgctgacactagcctgagttcccctaacaatgttattttctacaacagaagctgggacagaggaacaaacacagcccactcaagcagtggtggcaacattctgttagaaaggaggggagtcaaagaaaaaaacacccctccgcccatctccttatcacctccctaaagacagaggagaacatggacaccctccatcctgatagacatgccatgtggtcagtttgtgcggtaaacaggaaaaaaaaaaacctaaagatattgtagacctttattttctttaaatctcctaataaaaacattaaactttca

SEQ ID NO: 416058 - DNA, 3994 bp, Homo sapiens
tgggtttttaccagcaacaaaaaatttattgaatgagaagaaccatggtgtcctccacacatctgtagtcctcctcacagaaatgtgtgagcgaagcccagacatgcttgcgcatttcagagagaatgaaaagcttgtgccccaattagttcgtattttaaagaacctcatcatgtccggatattcaccaggacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattaggtatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcggagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacagggtctcactctgtcagccaggctggagtgcagtgggattatctcggctcacttcaacctctgcctcctgcgttcaggtgagcctcctgcctcggcctcctgagtagctgggattataggcgaatgccaccatgcccggctaattttttgtatttttagtagagacggggttttgctgtcttctttaaggggataatgaagagttaaagcacacatgaccttgagtaaaaaatagacataggataacaagttggatggttagctaagctcattcccacaggctgattttttttttcctaatacagtggagtcacagagtataggatttatgtctgtgtcttaacaaaatttcaaaatgttacttgtcatgtacttatgaatcatttacaaatggtcaatttcaaatcctcaaatgtcaaagctgtactggataaccggcaaagaaaaaacaaccccacagttaaaccatagcatatacttcacctaatatgttagtatttccatgttaatatatatagccttcataattataattttaggtgactaatactttatcaacaaatttgctctgtttactcagttcgttagtattgggtagtttggcttttttttttggtttttttgaaacggaatcttgctttgttgcccgggctggagtgcaacagcacgatcgcggctcactgcaacctctgcctcccgggttcaagtgattctcctgcctcagcctcccgagtagctgggatttataggcacgtgccaccatgcccagctaatttttgtatttttttatttgagatggggtttcaccatgttggccaggctggtcttgaactcctgacctcggatgatcctcccgccttggcctcccaaagtgctgggattacaggcatgagtcaccgcacccagccagtatggggtattttgtttctagatttttctacctagcggccccaacaaatattacatcaatttgttcttattttagattaatttgttagactaagtgacttagtctttctgaatctggttaaaattaggatgattaatacttactccataagatatttgtgaggcccattgacctattcagtgcatgatacatagtaggcacttggtaaatattatttaccttttcctcaatttatatgtttaaccgcacagtcataagcattgtatattatcattttaaaaagccctattgggtgaaaatttggtcctattatattttatttttattattatttttttaaattttgtagccctctgccaggcttggtcagcagagagaggccctattattttttgatcacagagcgagactccatctcaaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatca

SEQ ID NO: 416059 - DNA, 6155 bp, Homo sapiens
tgggtttttaccagcaacaaaaaatttattgaatgagaagaaccatggtgtcctccacacatctgtagtcctcctcacagaaatgtgtgagcgaagcccagacatgcttgcgcatttcagagagaatgaaaagcttgtgccccaattagttcgtattttaaagaacctcatcatgtccggatattcaccaggacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattaggtatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcggagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacagggtctcactctgtcagccaggctggagtgcagtgggattatctcggctcacttcaacctctgcctcctgcgttcaggtgagcctcctgcctcggcctcctgagtagctgggattataggcgaatgccaccatgcccggctaattttttgtatttttagtagagacggggttttgctgtcttctttaaggggataatgaagagttaaagcacacatgaccttgagtaaaaaatagacataggataacaagttggatggttagctaagctcattcccacaggctgattttttttttcctaatacagtggagtcacagagtataggatttatgtctgtgtcttaacaaaatttcaaaatgttacttgtcatgtacttatgaatcatttacaaatggtcaatttcaaatcctcaaatgtcaaagctgtactggataaccggcaaagaaaaaacaaccccacagttaaaccatagcatatacttcacctaatatgttagtatttccatgttaatatatatagccttcataattataattttaggtgactaatactttatcaacaaatttgctctgtttactcagttcgttagtattgggtagtttggcttttttttttggtttttttgaaacggaatcttgctttgttgcccgggctggagtgcaacagcacgatcgcggctcactgcaacctctgcctcccgggttcaagtgattctcctgcctcagcctcccgagtagctgggatttataggcacgtgccaccatgcccagctaatttttgtatttttttatttgagatggggtttcaccatgttggccaggctggtcttgaactcctgacctcggatgatcctcccgccttggcctcccaaagtgctgggattacaggcatgagtcaccgcacccagccagtatggggtattttgtttctagatttttctacctagcggccccaacaaatattacatcaatttgttcttattttagattaatttgttagactaagtgacttagtctttctgaatctggttaaaattaggatgattaatacttactccataagatatttgtgaggcccattgacctattcagtgcatgatacatagtaggcacttggtaaatattatttaccttttcctcaatttatatgtttaaccgcacagtcataagcattgtatattatcattttaaaaagccctattgggtgaaaatttggtcctattatattttatttttattattatttttttaaattttgtagccctctgccaggcttggtcagcagagagaggccctattattttttgatcacagagcgagactccatctcaaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaggctgttctttttttttttttggaggcgaggttaaagcattactatttgcaaagcactctgtagctccctgttatggggataggtaactaatcagaataataatgtcactcgcatccacttcttagaacctggctccaaaggaaaataagctgatagactcaatcactttcctgaggatggaggcctatggcatgtgtggctgcaggtcgcgaagctgcttaatggtgctgggaagcctagaggaattaaataaagaccctggaggaggtgggatcggagctgcaccttgaacaaatagctcagatttgaacagatggatggaaaagagggaggtgttcccaaccaaggggacatgatacagggaacaggtcctatgtctctttactcctgagagtattaaacctagtaggtgggcagcccctcttggttgcctgttaccttattttgaattctttttgcaaaacatactatcacccgtccaaataatcttttgtctaaatccagacttcacattctgactggggcaaaaagaggcagtccagtaaaggttataaaataggtaccatcattgtttgccttatttagaaaagcttccaattttcactataatcaccctaagcctgagagaggtgaactgttcaagggtactttggctccagtgggtgacagtacctggcccagctttggaattgaaacatttctgatggtctgtactctgctagaacacaggatgcttctgctctccctgctctggcatcctgccaggtgtcatggccacgcacaggcatgaagacagccgggaagccagagttcccacgaagcactcactccttggacttgctcccaccccactggggagagcactcctggagcaggaaatgagcatctctcatctccctgaattccacatccactggctgaatgatcagggaggcatagcagtgagagccataggtcggcagagggaactcaggccctcctttaggatggccatcacctcatctcaatccagccaaatcaaccatctagagcacacaggccgagagaaatgtaataaaatataacatgagacacgtatgaaatttaaactttccggtagccacactagaaaaaggtaaaaaaaaaaaaaccagtgacattaatttaaatttaattttagataatccaacagatctaaaatactatcatttccacatgtaaccagtattttcatgtgtttttttctgcagtaaatctttgaaatctggtgtgtgttttacactgacagcacactcgattcagatgctagattttccttgtagatatttggtcgttatttagatttcataaaatttacagtttaaaagattccaatatccgagttgctccaaacacacttagaagttgttttccaaataatggaatcaatgatcggcttttagatgtaaacttattaaaataaagtagcgtttctcagttaagtcacattccaagcgctcagatccatgccctgcgcagacccggacgacgaacccgactttcagagactgagggttctgcctagagagctcccacagaaatcagcccgagaagaaagccttgtgggtgaagccagggagggagacaggagggcaggaggaaaatcaagcctaaatgagcacatcgtggacgccgctcttcctctccccacatctcctcgcctcgccgcagtgggcccggctgtgccccaggtccccgcggtcgggagtgaatggcgctcgggtggcaggcacgtgggcacctggtgaactgcaggaccctggcaccgccaccccctcgcccctacacacacaggagtgcccctcccgttgtcacgtggccttcctgctgggtatctggagcagttgcagcctcgcttccggaaggaaacggggcctctggggcacagggaccacctgccagtgcgttccagccgggctgccatccacactggagaccgccccgcacgtggtcctcgggctcggattcagctgtcgcaggatgtgaggggaaaggtatgtggcccgacaatgccaccgagggtgtccccgggctccaccccgtgcctcttcattatagaatgactgggcagagataagggccagattactttgctgtattgaataattcaccataaaaatgattgcaaccaggaaaaaaaat

SEQ ID NO: 416060 - DNA, 4666 bp, Homo sapiens
  misc_feature (4646)..(4646): n is a, c, g, or t
tgggtttttaccagcaacaaaaaatttattgaatgagaagaaccatggtgtcctccacacatctgtagtcctcctcacagaaatgtgtgagcgaagcccagacatgcttgcgcatttcagagagaatgaaaagcttgtgccccaattagttcgtattttaaagaacctcatcatgtccggatattcaccaggacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattaggtatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcggagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacagggtctcactctgtcagccaggctggagtgcagtgggattatctcggctcacttcaacctctgcctcctgcgttcaggtgagcctcctgcctcggcctcctgagtagctgggattataggcgaatgccaccatgcccggctaattttttgtatttttagtagagacggggttttgctgtcttctttaaggggataatgaagagttaaagcacacatgaccttgagtaaaaaatagacataggataacaagttggatggttagctaagctcattcccacaggctgattttttttttcctaatacagtggagtcacagagtataggatttatgtctgtgtcttaacaaaatttcaaaatgttacttgtcatgtacttatgaatcatttacaaatggtcaatttcaaatcctcaaatgtcaaagctgtactggataaccggcaaagaaaaaacaaccccacagttaaaccatagcatatacttcacctaatatgttagtatttccatgttaatatatatagccttcataattataattttaggtgactaatactttatcaacaaatttgctctgtttactcagttcgttagtattgggtagtttggcttttttttttggtttttttgaaacggaatcttgctttgttgcccgggctggagtgcaacagcacgatcgcggctcactgcaacctctgcctcccgggttcaagtgattctcctgcctcagcctcccgagtagctgggatttataggcacgtgccaccatgcccagctaatttttgtatttttttatttgagatggggtttcaccatgttggccaggctggtcttgaactcctgacctcggatgatcctcccgccttggcctcccaaagtgctgggattacaggcatgagtcaccgcacccagccagtatggggtattttgtttctagatttttctacctagcggccccaacaaatattacatcaatttgttcttattttagattaatttgttagactaagtgacttagtctttctgaatctggttaaaattaggatgattaatacttactccataagatatttgtgaggcccattgacctattcagtgcatgatacatagtaggcacttggtaaatattatttaccttttcctcaatttatatgtttaaccgcacagtcataagcattgtatattatcattttaaaaagccctattgggtgaaaatttggtcctattatattttatttttattattatttttttaaattttgtagccctctgccaggcttggtcagcagagagaggccctattattttttgatcacagagcgagactccatctcaaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgtggatgagttttgtgagagaacagagagaccattgtacctggcacaagggctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatcaaaaaaaaaaaaaaaaaaaaaaaaaaaaaaaaaaaaaagagggggggcgcgcgcccaaaaattccccccgggggggccccagtttgccgcctcccccggtttttggtgtcaaccaggggggccccctaaggagcgagccgtattataataagccgctaagggacctcggcgcccgcgctggtttcaaccacaccgttcgcggttcgacctgggagacaacaactgtcgcaaacggtcggggagcaacctccttggggaagagaccgagccccctttacacctctcgggcgggggggcgcacaatcctttgcgggaccgaacctcttcccctttaacaggagttttataaagccgctcctgagggggcacaaatctacaaccttcttcacacgcctgtgtatgcacggcggtgtctaaacacccacccagcgaccacatattatcgcctgggccggccttgaaaaaaagttttgcgggctgccccgcagggttacctgtatctgtgcggacacattttttttcttcccgggcactgtgtgctccaataaaaacgggcgcgacgctgacagagaagcggccgctagcaagcgccgtcacacagtacacgcgggccgactcgtgacacgacgacctcgcacagcgcacactaccanccatgacacacacatcgctg

SEQ ID NO: 416061 - DNA, 796 bp, Homo sapiens
tttctcctctcctcttgctgctcagcacagcccagtaagtctccctgttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccaggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactacaagaaattataaatgtttttcacatca

SEQ ID NO: 416062 - DNA, 505 bp, Homo sapiens
gctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaa

SEQ ID NO: 416063 - DNA, 1375 bp, Homo sapiens
aagatacctgaggaagatctctttattccttccccttcccactccccatcaaccaggtccccctgcagcacccttccttgtgaaatcacagctgctatgacagtgaccagctccaaaccaccctgtgtcactgaaccttgggtgctgggtgacacatgggcaggaaaggcaggaagagcagggatctgagggcctgggggctgggcaagcctcaggggtggggtgggtgctgatcaatgccaggtgatcaatgccaggtgattggacccactgagtaccaggacaaacctggagtcacgcaactggcctacatcagttgccttggcaacacactgcccttgaccctacccggaaaagatttatttcagccggtagccctggtaacttgagtggctccccagggacaggaagtggcagaacctcaactctgcctctcctgacctgaggggttcacttttcatccctgtcagggacggggcactgcgttctcagcccctatggaagaatgttatgggtttgggggaatccacggggaggagactaggctgttccagcgtgcccctccttcctcagcctgaggccttgctcctctgtggaaggcaacacagggacagagccacacattcagcccctaccctcagccctgctcccatcccctggcccacaggtctgacccgcaagctccgatgtggagacacttggtggctgactcctgcttcctcacacatggggatggcccacaggtgaccgactggctgaatgctggggccatgctagaggactgctgtctgcagagcatggtccctgcattggccagaagttggtgtgagcccaggtgagtcactctagccccgtggtgtgtgtggtgggtttgaatctgcagctaccaggcaatgttttctccatttcctctcaagccaggcctttctccattctttgctactctccaggagaggcggctcactggagggctggagcctgagctgctggagctgtccccggccaaggagagcagctcctagtgtcagcctgtgcccagggaaccctggggcccgaggctgacctggcgttaacttcttactgcttcatccagctctcaccagccagcaggctggagtccttgtgggctggaggggagggagtctgcagggaggacccgggcctggacccagatagtgaggagatgccgggagacagcacagggtgacagaagcaggagaaaggccttcggtttagcctcagttccaaacctcggcgctcctggcattaagggaagggtgatggaagctggggggaaataacagaaaggctcctccccctaatacaccataacagattccagcttcccttcctccggctctaagcagaaaggaaa

SEQ ID NO: 416064 - DNA, 393 bp, Homo sapiens
aagatacctgaggaagatctctttattccttccccttcccactccccatcaaccagggtggcgaagaggggagaaagagaagagatggaacatgcaaaggccaggagcgaagcgggagaccacccaggagacagaaggagggcagaggctgggagaagaacaggaacagacaggatggggtcctgattgttggaaaagacagggaggccaatcccagccttgcaaatagcagcagctagaggttatttccagaaaaatctgcaaagtaaatacactgatcacccaactcccatatctctttgctgctctctgtggaagactcagacaaaccccaagaatgaatggccacagggccagggcaatggtggaaagggaggggcctcacctggcctt

SEQ ID NO: 416065 - DNA, 2202 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaacctatgttgtatgtgaattatttattataaacttagcacgattctgtgactgtttttctctgtttcacgttcgttgagtgtaagcaatgaaaatgtcccaaataagttttttaagttttactttaataagattaatttcagtaaacattctagttgttcagtgtaacctttttatcttgatgcattgtaagtaaaatgaatcatttactcttgaaatgccagtcattgactgatgtagataatttaggattttcatataaaaatagctgtttaggaaggtgaaatacattcactgtctctgttggtggtacatcttgttgaattcaatattagaaagtatttctttttggggtaatataacttagaattaaatccctgtttctctatgtagtctggcagtataaatataaatatttaccatataatcttggaataagtattagttaatgttaccaaaatctgtattaaataatgttttcaaatgct

SEQ ID NO: 416066 - DNA, 1773 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattgggtgaaaacttgaattttatcattggcaacaaatattgtcagttattttcactgaaatggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataattt

SEQ ID NO: 416067 - DNA, 974 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcagtttatcatcgttgactctttgcaaaggaaaaactacaagatgttttggattaaccggctgcagagggtcaaggcttctgcttagttttttctagttagtgtttgagttgaagtgttatacatttcttactgccgattgcttattacttaattgttcatgttttcagagttcttgcctattaaaattttattaatttggttaac

SEQ ID NO: 416068 - DNA, 854 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcaggaatttccattttttaccttgacggcatttcctcctggattccttgtacacgtgggggtgtagttagtgcacgttctgtgaagcttttggatcgtatccacaatcctgtgaagaggtctgcattttatctgcatctggcacagcggctgtactgaatcctagatttctgcaggatggcaccgtggaaggctgtttggcacagaggcttgaagaaaatttgctacacgtgtggattgtcatataccatatgatgaactgaatatgccatttccagctcatctcacatatgctataactgcaggaaacaaaagtcctgatgtctgtttacaactatagactccag

SEQ ID NO: 416069 - DNA, 2381 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaacctatgttgtatgtgaattatttattataaacttagcacgattctgtgactgtttttctctgtttcacgttcgttgagtgtaagcaatgaaaatgtcccaaataagttttttaagttttactttaataagattaatttcagtaaacattctagttgttcagtgtaacctttttatcttgatgcattgtaagtaaaatgaatcatttactcttgaaatgccagtcattgactgatgtagataatttaggattttcatataaaaatagctgtttaggaaggtgaaatacattcactgtctctgttggtggtacatcttgttgaattcaatattagaaagtatttctttttggggtaatataacttagaattaaatccctgtttctctatgtagtctggcagtataaatataaatatttaccatataatcttggaataagtattagttaatgttaccaaaatctgtattaaataatgttttcaaatgctaaatatggtcgttactattttcagttttaaaaattttatagtatcaaattgtttctaaccaaaaatttccttttacttctagagatgctttatgtttttgattattaaatagtcactagtattgctaatttttgaaacaaatacacaaaatttatcatatgtagaaataagaaaatatt

SEQ ID NO: 416070 - DNA, 2093 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaacctatgttgtatgtgaattatttattataaacttagcacgattctgtgactgtttttctctgtttcacgttcgttgagtgtaagcaatgaaaatgtcccaaataagttttttaagttttactttaataagattattcgtaacatctagtgtcgtgtactttatctgaggctgtagtaagatcttactctgaagcgcatgcggtgatcatgggttcctaacaacggttgggggaacttccgcggggcctcgggatcactaaagatctctgggaaaaaaaacgttctgggggaaaatcaatcggagattgggccgtttgttaaaaaaggcgcttattggtgttttttgtttattacatctcacactctggaaagagaag

SEQ ID NO: 416071 - DNA, 2056 bp, Homo sapiens
aagcttgcggccgccgaggagggcctgcgcgagctgcagcgcagccggcggctctgccacgaggacgtggaggcgctggccgccatctacgaggagaaggaggcctggtaccgcgaggagagcgacagcctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaacctatgttgtatgtgaattatttattataaacttagcacgattctgtgactgtttttctctgtttcacgttcgttgagtgtaagcaatgaaaatgtcccaaataagttttttaagttttactttaataagattaatttcagtaaacattctagttgttcagtgtaacctttttatcttgatgcattgtaagtaaaatgaatcatttactcttgaaatgccagtcattgactgatgtagataatttaggattttcatataaaaatagctgtttaggaaggtgaaatacattcactgtctctgttggtggtacatcttgttgaattcaatattagaaagtatttctttttggggtaatataacttagaattaaatccctgtttctctatgtagtctggcagtataaatataaatatttaccatataatcttggaataagtattagttaatgttaccaaaatctgtattaaataatgttttcaaatgctaaatatggtcgttactattttcagttttaaaaattttatagtatcaaattgtttctaaccaaaaatttccttttacttctagagatgctttatgtttttgattattaaatagtcactagtattgctaatttttgaaacaaatacacaaaatttatcatatgtagaaataagaaaatatt

SEQ ID NO: 416072 - DNA, 1714 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataattt

SEQ ID NO: 416073 - DNA, 1038 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggtaaaattatttttacatttgaaattatgttttacattgctttgctctatgatagggtttcaaaggtaattgtaaagtttcattgtataaaatctggttttctttctttgcattgaagtaaagtaa

SEQ ID NO: 416074 - DNA, 1078 bp, Homo sapiens
gtgaccggagcgagaaaccccgcctcggcaccctgacgcagcgcaggacccaccccgtgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtaggtatttgaccttagcagta

SEQ ID NO: 416075 - DNA, 422 bp, Homo sapiens
gctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcaggtaacgcccacacctcagctctgggtctcttatgcccctcacgcggctctgggggtcctca

SEQ ID NO: 416076 - DNA, 621 bp, Homo sapiens
ttctaaaacgtttttaaaaatctttatttgaaaatttcatataggcattcaaagaacattggctcactgaataggagactttacatctctcatggctgggcagcagctgtgtctggcttccttacttcaagatctgccttgatcacagatcacttaacagtggttaagtttcttattttcaagttcagcaggtaaacctatctcatttttggaggcattttttaagtataaaaagtctgttatttaggaaggttgcacagttcagaggtgaacatttcaatgtatttaaactttcctaaaaatgtaaaaataacaatcaaataggagaggtagcaaatccacagaggtataaataaaacaagaatggaagaatgctgataactgttaaagctgagtgatggaagttcattatatagtctgtttactttgtatatactaaaacttttccagaattaagtctgctacatcaaacagggattttttcctattttaaaaattaaattttttaaattaaaaaattttttcttactaatccttaatttttacctattatttgtttactccaaatttatttttatccttcttaaacagaacatcccaaacctataaccttcaggtttc

SEQ ID NO: 416077 - DNA, 1630 bp, Homo sapiens
acagtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttacttctaagagcaaaggaaagcccctgaagaagt

SEQ ID NO: 416078 - DNA, 595 bp, Homo sapiens
acagtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggagaagaaaatggggctccaattgagttaaaccaaaaaagaagatgtattagctcccat

SEQ ID NO: 416079 - DNA, 1506 bp, Homo sapiens
acagtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggtaaacctatctcatttttggaggcattttttaagtataaaaagtctgttatttaggaaggttgcacagttcagaggtgaacatttcaatgtatttaaactttcctaaaaatgtaaaaataacaatcaaataggagaggtagcaaatccacagaggtataaataaaacaagaatggaagaatgctgataactgttaaagctgagtgatggaagttcattatatagtctgtttactttgtatatactaaaacttttccagaattaagtctgctacatcaaacagggattttttcctattttaaaaattaaattttttaaattaaaaaattttttcttactaatccttaatttttacctattatttgtttactccaaatttatttttatccttcttaaacagaacatcccaaacctataaccttcaggtttc

SEQ ID NO: 416080 - DNA, 798 bp, Homo sapiens
acagtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggaagaaattcttagccaggcatggtggtgtgtgcctataatccctgctactcaggaggctgacgggggaggctgaagcaggaggataccttgagcccaggagtttgagaccagcttgggcaaaatagtgagatccagtcttaaaataaataaaagcatatcataaa

SEQ ID NO: 416081 - DNA, 1082 bp, Homo sapiens
catctcctgacctcaagtgattcacctgcttctgtctcccaaagtgctgggaatacaggcatgagccaccactcctggacaggccacagaaattttaaagaaaagaatcatgccaccacaagtaaacttcattttgtttatattatttaggacttcacatttgtcttccgaaaccatgaagtataattctgctaacagcaagtgttgtgaatgaggaattaggaattaggagaatggtagtacattgggaaaaacatattttagtaatttttatattttaaagataatcacagattttgctgtttgtgcatcaccaaaatcagtgagatctgccagctggtgggggtgtgcctatgagaatttttgattatgatcccctaggagggttatcaaaaaaggagatgggtgaaagatcaggagagtcgagaaattcattttttggacaacattgttttgaaggcactactggggctctgggatcaggcagccagattgaaacctggctcctccttttcctaagttatttaacctccctgtgcctcactttttgtcaaccagataagataagaaatgagagcaggtctgttacctcacaaggtggctgtgagtgttgaagacgtttgttgggggtttgggtgaagcatgcaaactctggttggtatgtggcagccactcagcctgtatttatgatgagggaggcattctaggcaccccttccaggatgttgggttgttggctgggttttactttaaaaagctcagggcctagaacattctagaatccaagtacttgctcacatatataattatttctttaggataatctttgatatagacttacgagtcaaagggtatgtaaaatgtcagcccttttacctgtattgccaaattgccttcaaaagtttctgctgttttgccctcctacccatagtgataaccttaaattggagtcaacacaaatttgagtgtgactgtgttagacagaagggatatattaacaggtaaaactggccatggcccctgcccttgtggagtatatgctctgttggttcatttcctctgcattctaattttctagacttg

SEQ ID NO: 416082 - DNA, 767 bp, Homo sapiens
gcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaagtgagtccatagaattctatgacctggaaactccccagtttttctctctagaaattctcgactttagtctcatatatctggttgttgacttgacatctctacttggatgtctctgagataccttaaactcaatatgtgtaaaatatatatagctcttgattttccattctgcaaaaataccattcatttcttggcctttctcctcacagtctttggcactacagttcacctagctgcacaaacctaaaacttgggagtcatctttatttatttttctgtagcatcttcattcaagttcatcaacccaacttctctgtactataaaattaaaataatacctttttagtaacatggaggattaaaggagttaataaataaatgtagcctttgaatagtgcctggcacatagttaacacaatataattgtagctactactgctactgttgttattactttttatcccctacagcatcaaccccctgcggcaagccaccac

SEQ ID NO: 416083 - DNA, 847 bp, Homo sapiens
gcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaacatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcac

SEQ ID NO: 416084 - DNA, 945 bp, Homo sapiens
gcattctgataatgtgtaggcaaagtttccacacttggtaaaagcatcttagtcatggttcaagacgagtgacaagttaccacctatttgcaattcaaggagaatataagacagagaagaaagctgtgaatgaatttcatttgattagcaatagattggacactctactgatcttgcctctctacaacctctcttccacctgacctctaaatgttgaagtgtttcaggaattgtcttagaccttcttccttatctacacttcctctccaatatggaattctcttccccaagctgttggcatgtctagttcatttgcattttgggcatttcagctcagctgtcatctcagtgaccagtttttatctgagcatgaatcttgatggctctgcacaagatcctgaaaagagggaatattcttctgtgtgtgtgggcagagaagatgacattaaaaaatctgaaagaatgacagctgttgtccatgatagagaagtggtcattttctaccacaagggagaatatcatgctatggatattcgctgttaccactcaggaggacctttacatttgggagatatagaggattttgatggacgaccgtgtatagtttgcccctggcataaatacaaaattactttggcaacaggagaaggtctgtaccagtctataaaccctaaagatccatcagcaaaacccaagtggtgctccaaaggaataaagcaaaggattcacacagtgacagtagacaacggaaatatttatgtgactctttctaatgaaccttttaagtgtgactctgatttttatgccactggagacttcaaagtaattaagagttcttcctgataaaaaatatatagaaatgaaaaatgttgtgtatgcttgaaaacatttttagaataactctgcttcagttttaaaggtgatgaaatttttcaacataggcac

SEQ ID NO: 416085 - DNA, 2763 bp, Homo sapiens
  misc_feature (398)..(398): n is a, c, g, or t
ggcggcgcggaggggcaggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcanctggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataaga

SEQ ID NO: 416086 - DNA, 2706 bp, Homo sapiens
  misc_feature (398)..(398): n is a, c, g, or t
ggcggcgcggaggggcaggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcanctggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaagtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataaga

SEQ ID NO: 416087 - DNA, 3497 bp, Homo sapiens
  misc_feature (398)..(398): n is a, c, g, or t
ggcggcgcggaggggcaggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcanctggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagaaaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttgg

SEQ ID NO: 416088 - DNA, 3443 bp, Homo sapiens
  misc_feature (398)..(398): n is a, c, g, or t
ggcggcgcggaggggcaggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcanctggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtacacagataagctgtttctctccaagttctttctcctggcgtcaggctgcctttgtggattcatattgctgggcggctgttcagcagaagaactcactgcagagcgagtctggaaacctcccactgtggctgcataagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcaggatataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagacgaaatctaaaggatattcacagtgacttcaattcaggaagaatgcttcctcaaagagtttgtctacaggcggtttctctgttatcaaaggcatttgaaataggattttacttaaacaataatggaacacaggagtatttaaagtgaagaacactttgcctgaatgtgatcagggcacataagtgacattggcgtgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagaaaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttgg

SEQ ID NO: 416089 - DNA, 416 bp, Homo sapiens
ggggcacacagtttatgtagatgtaaatgtggattttgttttaaaacacagaataccttccaccataaaactgacttcgggagagacatatcattctcaaattataggtgaatttaaagattttacttactacttttcctgacagaacatagatattaaaaataagcaagttttagtggataaaatcaggagaattataccaaatgcaaaactattaatccacttgtaaagaatacttgaagctctagctcccaaaacccaattgtaaagctgacaataaatttgttaaattaggttgtaaattaagcataatttaagtcctccaaaactgaattatattctgcagaactgtgagcaaatgctactataattttagtattcactcagtatgtttcttgttttgcttgtgtattgaa

SEQ ID NO: 416090 - DNA, 341 bp, Homo sapiens
  misc_feature (25)..(25): n is a, c, g, or t
  misc_feature (27)..(27): n is a, c, g, or t
gcggccgcctactactactaaattngnggccgctcgttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416091 - DNA, 1606 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416092 - DNA, 2139 bp, Homo sapiens
gcctcgtgccgattcggcacgagggtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggtaatggggcagagagatgggacctggggcaaaggctaagcgaaggagagctggagcgggtgaactaagagcgggggcgagatctgaggatggaaggctttgggggtgtcggaggcagagggacccgggggtttgcagcgaagggtgtctggagagggagagctgaggaggggccggttctgggggctgcagaacggggatttatggtgtcgactgggagcaggaggagggtcttcgaggggcctgggggcgggggactaagatggacgcctgggaagggaactgggaggcagcggggtgcctgggggccgagggctgaggacggggtgcggaggcgcactctgggaatgccgagagggtcccgcagagacgtcagggcgcccgtgcgggccggcggggagctggggggctaggggcggacgccgacgtgatggcccttcccgcaggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtgcgggccccgctcgcggacgctcgggggagggaagcgaatgggctcggcgagggaaaggacgccccgggccttatcagagcccccttggacccgcaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416093 - DNA, 1493 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaggatgaacaacctcagagaagaggtggtttagagcaaggaaaaaaatgaaaccagtgaccaaaatcgga

SEQ ID NO: 416094 - DNA, 1911 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggaaaaaaaaaaaaaaaaaaaaaaaaaaaaaaaaaaactctagagagggaatttattttggggggtgggagaaaaagaggggagaagtagagaagaggggcaaagtggggcaaaggggtgtttctgtgtgaccaagtttttgtgtgtgtaaaaggggggaaaattgttggcggggctccccctatattggggaggccggaatttaaatttcgcgaaataacccgggttaccccgggtttaagaggactgcggcaaacaacccccacaacaacagccaacaccacacacccgaccacagcagccgacgc

SEQ ID NO: 416095 - DNA, 1919 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatggtcagtcaggaaggggcagcaggctgggcccatcttccccctatccctttgattcatgctctgtttacacgcaccaccacataggtgctaacccccagggttctctaaagccagggcagggtcctgggggtccaggcagagtctgggctgcagacaagttgggcagatgttcggggtcaggcaggaggctgcaacccttgaccttgaccaccggttcacactctctcaccagctactggttactacatcttccgtggggcgaattcccagaaaaacactttccgaaagaatccttctgaccccagagtggctggtgagctggttctctagggccatgggtgaggtggggcagctgggcttcctgggaactctccaccctgctgtctttccccagggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416096 - DNA, 1551 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416097 - DNA, 1536 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416098 - DNA, 1573 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416099 - DNA, 1236 bp, Homo sapiens
  misc_feature (1077)..(1077): n is a, c, g, or t
  misc_feature (1079)..(1079): n is a, c, g, or t
  misc_feature (1099)..(1099): n is a, c, g, or t
  misc_feature (1104)..(1104): n is a, c, g, or t
  misc_feature (1107)..(1107): n is a, c, g, or t
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgtatggtactacatcttcngnggggcgaattccagaaaacnttcgnaanatctttgaaccaagtggtggttgaaccttttaagcacggcgaactgtgggcgggggcgatgccaccacattggcccatggctgtgcgccgggtgacggcaattactcaaccggtgcacgacgaaggaaa

SEQ ID NO: 416100 - DNA, 2042 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacgacggtgcctaggggacgggccctcgcgctggagttaagcggccgggggtggagctccaggcctagcggggaggtccacggagattggcccccacccaggctcctttgtgtgcctctgttacgcccaggacagacgccgggggctctccctatgcccctcgtccccacagccttaccccatttactgctactccgtgcaccacagcagtggctggggtgatcctctgaaggccagggtggcagcctaatgcttggggcagggtctgtggcccccctgagttttgggctctgcgtgtgtttgcggggtggggatgtggaggcgcgcagccccagggctcactgtgcgctgtggttcaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggtgaggctggactggacgagggtgggtgtctgagggccgcatagggactaagccagtgtgtctgggtcttgtccctgcaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416101 - DNA, 1594 bp, Homo sapiens
gcctcgtgccgattcggcacgagggtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416102 - DNA, 1838 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatggtcagtcaggaaggggcagcaggctgggcccatcttccccctatccctttgattcatgctctgtttacacgcaccaccacataggtgctaacccccagggttctctaaagccagggcagggtcctgggggtccaggcagagtctgggctgcagacaagttgggcagatgttcggggtcaggcaggaggctgcaacccttgaccttgaccaccggttcacactctctcaccagctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416103 - DNA, 2011 bp, Homo sapiens
  misc_feature (1964)..(1964): n is a, c, g, or t
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggaaaaaaaggagaagaatacaaagaaataacaagaaaagactgggaccgggggtgctgttctgtgtggcggcgtggggaacgagcgggtgaccagtaccaggggcggatgtcgtgcgcctcgagagggttcgcccaggctcgcctgattctccttgtgtatgccacgtgggtgcgagcatcgggggggcgctccccgtatctgtgggcagggtcaattccctggcagcacacggcgcccgtgtgtgtgtccccgcgcgcttgttctcaatttgggggggaacctcctgacgtccccgagggacgggctgccttattgtgtgccctgttgtccccgggggcgacttcctcccaggaccggncactgccgagacacgggggctgggttgggagacagtcacgcgagggg

SEQ ID NO: 416104 - DNA, 1962 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacgacggtgcctaggggacgggccctcgcgctggagttaagcggccgggggtggagctccaggcctagcggggaggtccacggagattggcccccacccaggctcctttgtgtgcctctgttacgcccaggacagacgccgggggctctccctatgcccctcgtccccacagccttaccccatttactgctactccgtgcaccacagcagtggctggggtgatcctctgaaggccagggtggcagcctaatgcttggggcagggtctgtggcccccctgagttttgggctctgcgtgtgtttgcggggtggggatgtggaggcgcgcagccccagggctcactgtgcgctgtggttcaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416105 - DNA, 2061 bp, Homo sapiens
accctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtgcgggccccgctcgcggacgctcgggggagggaagcgaatgggctcggcgagggaaaggacgccccgggccttatcagagcccccttggacccgcaggtggccgaggggcaggaattgaaggacaagagtcgcctgcgctatcctattaacgacggtgcctaggggacgggccctcgcgctggagttaagcggccgggggtggagctccaggcctagcggggaggtccacggagattggcccccacccaggctcctttgtgtgcctctgttacgcccaggacagacgccgggggctctccctatgcccctcgtccccacagccttaccccatttactgctactccgtgcaccacagcagtggctggggtgatcctctgaaggccagggtggcagcctaatgcttggggcagggtctgtggcccccctgagttttgggctctgcgtgtgtttgcggggtggggatgtggaggcgcgcagccccagggctcactgtgcgctgtggttcaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416106 - DNA, 1993 bp, Homo sapiens
gcctcgtgccgattcggcacgagggtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggtaatggggcagagagatgggacctggggcaaaggctaagcgaaggagagctggagcgggtgaactaagagcgggggcgagatctgaggatggaaggctttgggggtgtcggaggcagagggacccgggggtttgcagcgaagggtgtctggagagggagagctgaggaggggccggttctgggggctgcagaacggggatttatggtgtcgactgggagcaggaggagggtcttcgaggggcctgggggcgggggactaagatggacgcctgggaagggaactgggaggcagcggggtgcctgggggccgagggctgaggacggggtgcggaggcgcactctgggaatgccgagagggtcccgcagagacgtcagggcgcccgtgcgggccggcggggagctggggggctaggggcggacgccgacgtgatggcccttcccgcaggcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtgcgggccccgctcgcggacgctcgggggagggaagcgaatgggctcggcgagggaaaggacgccccgggccttatcagagcccccttggacccgcaggtggccgaggggcaggaattgaaggacaagagtcgcctgcgctatcctattaacgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416107 - DNA, 1025 bp, Homo sapiens
  misc_feature (25)..(25): n is a, c, g, or t
  misc_feature (27)..(27): n is a, c, g, or t
gcggccgcctactactactaaattngnggccgctcgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 416108 - DNA, 1138 bp, Homo sapiens
  misc_feature (979)..(979): n is a, c, g, or t
  misc_feature (981)..(981): n is a, c, g, or t
  misc_feature (1001)..(1001): n is a, c, g, or t
  misc_feature (1006)..(1006): n is a, c, g, or t
  misc_feature (1009)..(1009): n is a, c, g, or t
gcctcgtgccgattcggcacgagggtccaggcaggtgcaggcgccgcggggccggatcctccgcgcggccgagtccatctcctgggaaatggggcggacagtgtttccttgactgactattgcgccgcggctctgctactgctgctgcccgccaccatgttccacctgctcctggcggcccgttcgggccccgcgcgcctgctgggtccacccgcgtccctgcccgggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgtatggtactacatcttcngnggggcgaattccagaaaacnttcgnaanatctttgaaccaagtggtggttgaaccttttaagcacggcgaactgtgggcgggggcgatgccaccacattggcccatggctgtgcgccgggtgacggcaattactcaaccggtgcacgacgaaggaaa

SEQ ID NO: 416109 - DNA, 440 bp, Homo sapiens
  misc_feature (310)..(310): n is a, c, g, or t
  misc_feature (420)..(421): n is a, c, g, or t
  misc_feature (423)..(423): n is a, c, g, or t
  misc_feature (428)..(428): n is a, c, g, or t
  misc_feature (436)..(436): n is a, c, g, or t
atttttcttccttgtgtagtgacagtgtttattgttgttccgaagccaatttgaagcttaactttagaaacattatatattaatctgaccatatttggttttaaaaaagtctctatgagtgaaataaagattttctgtttaatgatgattaataacctattcggatggattcatctgaggaactgaagataattttgccatcaggccacttgtatatgggcacaaacagatgggtcttactccagcctgggcaacagagcgagactccaactcagaaaaagcaaaacaaaacaaacaaacaagcaaaaanccacaattagactgacagctgacttttttaggagcaacattggaaggctaaatgcaatagaaagatgtctttgatgccttaagagaaataaatgttgttttagaaagcannanacttnaaaaaaanaaaa

SEQ ID NO: 416110 - DNA, 1198 bp, Homo sapiens
gggttcccgcgcggcgctccaaagctcggggagtggttgtctccctttcctggagtcatttgtgggagttagggtcttatcctgatctttcctcgtcccccgctcccccgtcctccgaggtggcagctgcgtagatcgggggtcatactacacatcgatcgggaccttagtcatgttgtgatatggacagctttcttaccagtactcataagcctgcttcattttttacgtggcggcaccactgagtggttgacgaagtctggaacgttttttcttagagttccagaattgtgactgaagtgtacccagagacacaaagaaatacagaagtccagaatgatcaaatgagatcactacccaatgaaatgataggccgaggagccagaaattgtcctactacctgctttccaggtccagattccacgagagccttctgggctcccaccagagaccctcagtgaagactctgttgaagactttaagaccatgctagaaagcctcccggcagaggttcaggaagttctgctatgaggatgcagctggccccagggatgtcctcaggcatctctaggaccttgctggacggtggtggctgagacctgatatccacacaaaggagcagactgtggaaatgctggtgcaggagcaattccaggctgtcctgcccgaggagctcagagctcaagcacagagatgtcatcctggaatcagaatcactggctaagtcttgctgcttgcttcttgctcagcctgcatatgagaagtcaaccaagcattctcttggatgcaagatccaactgcacccatgggaaatctgaacttccactttctttgagcttgtctttggttgtaataagaatccatcaaaacccatgtctggatctctctttggctgaggcagctttatttcctacagagtttctctgtcctcttgttaggacaatcagcctgctgctttgggcttttccaagagcctatttttcatctgctggatgcctctttttttttttttttttgcactttgtgacatgctttaatatatatattttttatgtatccaaagaggtaatcaactttaactttcagaattcatgaatcttggtttggtggcatgaatgaaaggttatgtaaccccaccagtaactcatttggggtgcccttgaaatattaaagtttggtcctcaataaaaaaaaaaaa

SEQ ID NO: 416111 - DNA, 1077 bp, Homo sapiens
gggttcccgcgcggcgctccaaagctcggggagtggttgtctccctttcctggagtcatttgtgggagttagggtcttatcctgatctttcctcgtcccccgctcccccgtcctccgaggtggcagctgcgtagaagtctggaacgttttttcttagagttccagaattgtgactgaagtgtacccagagacacaaagaaatacagaagtccagaatgatcaaatgagatcactacccaatgaaatgataggccgaggagccagaaattgtcctactacctgctttccaggtccagattccacgagagccttctgggctcccaccagagaccctcagtgaagactctgttgaagactttaagaccatgctagaaagcctcccggcagaggttcaggaagttctgctatgaggatgcagctggccccagggatgtcctcaggcatctctaggaccttgctggacggtggtggctgagacctgatatccacacaaaggagcagactgtggaaatgctggtgcaggagcaattccaggctgtcctgcccgaggagctcagagctcaagcacagagatgtcatcctggaatcagaatcactggctaagtcttgctgcttgcttcttgctcagcctgcatatgagaagtcaaccaagcattctcttggatgcaagatccaactgcacccatgggaaatctgaacttccactttctttgagcttgtctttggttgtaataagaatccatcaaaacccatgtctggatctctctttggctgaggcagctttatttcctacagagtttctctgtcctcttgttaggacaatcagcctgctgctttgggcttttccaagagcctatttttcatctgctggatgcctctttttttttttttttttgcactttgtgacatgctttaatatatatattttttatgtatccaaagaggtaatcaactttaactttcagaattcatgaatcttggtttggtggcatgaatgaaaggttatgtaaccccaccagtaactcatttggggtgcccttgaaatattaaagtttggtcctcaataaaaaaaaaaaa

SEQ ID NO: 416112 - DNA, 3162 bp, Homo sapiens
gtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcctcccagcccggacctgccacagcccagcccacagcccctgccacatccatgctcactgtctctttgaacgcaatggtgcagtgtcctgccagtgtaacgtgggctgggctgggaatgggaacgtgtgtgggactgacacagacatcgatggctacccagaccaagcactgccctgcatggacaacaacaaacactgcaaacaggacaactgccttttgacacccaactctgggcaggaagatgctgataatgatggtgtgggggaccagtgtgatgatgatgctgatggggatgggatcaagaatgttgaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagtgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaa

SEQ ID NO: 416113 - DNA, 1078 bp, Homo sapiens
gacctggaacctgtcttatcaacgtggatagggatcatctgacctggaaggcatcatcatttacagaagagaaaatcaaggccctgacttcacaggcctcggttcaacactttgtccacaactttgcatttctctccaacaagtagccctagttggtggagatgaacaggaagggaggggaaatgggtctgcttagaggctggactttccatggccaagagcccagagtccaggaacctgggttggttcccctttaaggtgcctggggctgtggggtgccaggacaggggataaaagggggtggactagagcctgggaagcgggtgacttcaccccccagcccattgtgcttattgtcatggcaacccaatcctcgcttggaatgcggctggtgctttgagatgcaaaaggagctggacaaagagctaggggccccaggcctgagaaaagcaccccccttccctctccttcctgcctccctttccctccctcccttctctctcaggcctggtgagctcaaggggggctggggaaaagcaaggccccaggcatggtggcacagtgcccactggcaccctagcaccaatggatactcctatcctggaatcctggacagggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaa

SEQ ID NO: 416114 - DNA, 539 bp, Homo sapiens
aggcttgtggacgttggcctgggtgaggagagattacctgcagcagatgtcaataggaatgtgaggtagggcgtagtgttaggcagagtgtggaactagagggtgagacaagaaacaggcagatttcctggccagttgtcctctgggtggggagacaaagttcgggactttcaccaactgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatgctgtgggactcaggccgggcctgtccttcctctttagctgggattcaccagtgacctctccatgggtgggaactgcagccacttctctccatcacccttctcaccacggacacaagcacctatgagtgatgttggtgaagtcactcctcccctcgtgccg

SEQ ID NO: 416115 - DNA, 538 bp, Homo sapiens
ttttgagatggagtcttgctctgtcactcaagctggagtgcagtgatatcggctcactgcaacctccacctccagggttcaagcgattttcctgcctcagcctcccgagtagctgggattacaggcgcgtgctaccaagctcagctaatttttgtgtttttagtagagacagggtttcatcgtgttggccaggctggtctcgaactcctgacctcaggtgatctgcccgccttggcctcccaaagtactgggaatacaggcatgagccactgtgcccaggccatagtatattctaaattccttctatgatttagccttaattctctattgctattcagcaggaatttattcttacagtcatccctccattcctactgccagaccttcacctcacctggctgactgccaggggtctgattgtatggagagcaggctccagagactcccaggcagaagcgaagggaaggacaaggagtacctttaaatcctttatttggtacctgttcttctcgacgcggccgcgaatttagtagtagta

SEQ ID NO: 416116 - DNA, 1470 bp, Homo sapiens
gttctagtaacaaccttgtgctacccatgtcttctaggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagtgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaa

SEQ ID NO: 416117 - DNA, 1495 bp, Homo sapiens
agcgtacacacgattgcatggcgaaggagatctccttctataacttggttgtcctgctaatggcatccccaatggattggacaattgccctaaagtccccaacccactacagacagacagggatgaggacggggtgggagatgcttgcgacagctgccctgaaatgagcaatcctacccagacagatgcagacagcgacctggtgggggatgtctgtgatactaatgaagacagtgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaa

SEQ ID NO: 416118 - DNA, 1957 bp, Homo sapiens
ttttgagatggagtcttgctctgtcactcaagctggagtgcagtgatatcggctcactgcaacctccacctccagggttcaagcgattttcctgcctcagcctcccgagtagctgggattacaggcgcgtgctaccaagctcagctaatttttgtgtttttagtagagacagggtttcatcgtgttggccaggctggtctcgaactcctgacctcaggtgatctgcccgccttggcctcccaaagtactgggaatacaggcatgagccactgtgcccaggccatagtatattctaaattccttctatgatttagccttaattctctattgctattcagcaggaatttattcttacagtcatccctccattcctactgccagaccttcacctcacctggctgactgccaggggtctgattgtatggagagcaggctccagagactcccaggcagaagcgaagggaaggacaaggagtacctttaaatcctttatttggtacctgttcttctgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatgtaagcctgcggacccagagcacgttagactggtgttgcctttgcccaggtggaggcagcaagccctgttgggaagtgaggaagggcaaggtggggaaagatgtcaggaatgcaggcccaacagatggtattgttgcctaatggcagtggccagggccttcctgagcacccagcctcactctgcccaggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaa

SEQ ID NO: 416119 - DNA, 1626 bp, Homo sapiens
aggcttgtggacgttggcctgggtgaggagagattacctgcagcagatgtcaataggaatgtgaggtagggcgtagtgttaggcagagtgtggaactagagggtgagacaagaaacaggcagatttcctggccagttgtcctctgggtggggagacaaagttcgggactttcaccaactgattagcgatggggatgggcatcaggacaccaaggacaactgcccacagctgccaaatagctcccagctggactctgataacgatggacttggagatgagtgtgatggggatgatgacaatgatggcatcccagattatgtgcctcctggtcccgataactgccgcctggtacccaatcccaatcagaaggactcagatgtaagcctgcggacccagagcacgttagactggtgttgcctttgcccaggtggaggcagcaagccctgttgggaagtgaggaagggcaaggtggggaaagatgtcaggaatgcaggcccaacagatggtattgttgcctaatggcagtggccagggccttcctgagcacccagcctcactctgcccaggcaatggcgttggtgatgtgtgtgaggatgactttgacaatgatgctgtggtcgaccccctggatgtgtgtcctgaaagtgcagaggtaacgcttacggattttcgggcctatcagaccgtcgtcctggatcctgagggtgatgctcagattgacccaaactgggttgtgctcaaccagggcatggaaatcgttcagaccatgaacagtgaccctggcttggcagttggatacacggccttcaatggtgtggactttgaaggcaccttccatgtgaacacagtgactgatgatgactacgcaggctttctcttcagttatcaagacagtggccgcttctacgtagtcatgtggaagcagaccgagcagacctactggcaggctacacccttccgggcggttgcccagcccgggctgcagctcaaggcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaa

SEQ ID NO: 416120 - DNA, 1977 bp, Homo sapiens
gtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtttgggtgggctggcgaagggtggcactgattctggggtagggtggcagatgtcaagtgctgactcctccccatccttctccaggtgaaggaaatgtccctgatccgaaacaccattatggagtgtcaggtgtgcggcttccatgagcagcgttcccactgcagccccaatccctgcttccgaggtgtggactgcatggaagtgtacgagtacccaggctaccgctgtgggccctgcccccctggcctgcagggcaacggcacccactgcagtgacatcaatgagtgtgctcacgctgacccctgtttcccgggctccagctgcatcaacaccatgcccggcttccactgtgaggcctgtcctcgagggtacaagggcacacaggtgtctggtgtgggcattgactatgcccgggccagcaaacaggtctgcaatgacatcgatgaatgcaacgatggcaacaatggtggctgtgacccaaactccatctgcaccaacactgtgggctctttcaagtgtggtccctgccgcctgggtttcctgggcaaccagagccagggctgcgcagtgacatcagtgtctggcccaggtgagcacctccgaaatgccctgtggcatactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgcgaggggggcgtcttggtgtattctgcttctcccaagaaaacataatttggtccaatctccagtatcgatgcaatgacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaaaaaaaaaaaa

SEQ ID NO: 416121 - DNA, 1024 bp, Homo sapiens
gtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaagtactggtgcgataccagcgggaggatggcaaagtccacgccgtgaacctacagcaagcgggcctggctgatgggcgcacacacacagttctcctgcgactccgaggtccctccagacccagccctgccctacatctctacgtggactgcaaactgggtgaccaacatgcaggccttccagcactggcccccattcctccagcggaggtcgatgggctggagattaggactggacagaaggcgtatttgaggatgcagggctttgtggaatctatgaaaattattctgggtgggtccatggcccgggtaggagccctgagtgagtgtccattccaaggggacgagtccatccacagtgcagtgaccaatgcactgcactccattctaggggagcagaccaaggcgctggtcacccaactcaccctcttcaaccagatcctggtggagctgcgggatgatatacgagaccaggtttgggtgggctggcgaagggtggcactgattctggggtagggtggcagatgtcaagtgctgactcctccccatccttctccaggtgaaggaaatgtccctgatccgaaacaccattatggagtgtcaggtgtgcggtgagtgggagagcaggggaggctccacatgaccgtgccacgttccccacccaatggctttggctttcccttctggtggcttaaatagtgaccaccgggtagctctgact

SEQ ID NO: 416122 - DNA, 679 bp, Homo sapiens
gtagtgagccggctgagaggcatggagacgcaggaacttcggggggccctggctcttctcctcctttgctttttcacatctgccagtcaggatctgcaggtaattgacctgctgactgtgggcgagtctcggcagatggtagctgtggcagagaagatccggacagccttgctcactgctggggacatctacctcttatccaccttccgcctgccccccaagcagggtggtgtcctctttggcctctattctcgccaagacaacactcgatggctggaggcctctgttgtaggcaagatcaacaaaggtgactggtgggcatctcctttcttgcaatggtgacctccttaagcactctccctcatccctacttcccaagtgcttcctcattctccttggcctccactagggaccaaggtcccatcaggctgtgcccagacatcaggggcacctggtatggggtgcttataaggtgctttaggagcccatgtaccaaacaatagggtgaggcttgagtcctgatatttatagggatgggaggttgtacttggggatgcctggaaggagggtgaggcatgtctctgtgcctcagcggtgatacagaaaggtctttcagatccctggaacaggtcagtggccacaaaaccagctgtcaccctaggagaggatacagtcatct

SEQ ID NO: 416123 - DNA, 286 bp, Homo sapiens
gaactcctgaccttaggcgatccacctgcctcaacctcccaaggtgttgggattacaggtgcgagccaccatgcccagccaagggttgaattttgaggtgactaacgctgcctggtggtgggggtagggggtgatgtgggctcgggggagggcataccttagcatttgatcccattctctaaccttgataacccctgcctgaccagtaattgacctgctgactgtgggcgagtctcggcagatggtagctgtggcagagaagatccggacagccttgctcactgct

SEQ ID NO: 416124 - DNA, 301 bp, Homo sapiens
tgggacggggggcctgggagggatagcacacctgcatcacagctttttctttactatacaaccccagggcatggaaatcgttcagaccatgaacagtgaccctggcttggcagttggtatgtaagggatatgcagttcaatcacttccaaatggaggaatcctataggggcagagggtaggggaggaaacagacagggagaatgggcaaagtggcgagagagaaggcagtggcacaagctggccacatacatagcaggcatcccttcccaactttaccccatgatgggccgccagtagctt

SEQ ID NO: 416125 - DNA, 1116 bp, Homo sapiens
ttttcttttctactacatggcaggttgaaaattttccaagcttttatactctgctttccttttaaatataagttccaatatcaaaccacctcttcggaaatgcatatgagcatatgctgttagaagcagccaggtcacttcttgaatgctttgctgctttgaaatttcttccaccagatactctaaataatctctctcaagttcaaagtttcacagatccctagagcaggggcacaatgccaccagtctctttgctgaagcatagcaagaatgacctttactccagttcccaataagttcctcatctccctctaagacctccttggcctggacttcattgtccatatctcactatcagtattttggtcaaagccattcaacaagtctctaggaagttccaaactttcccttatcttcttgtcttcttctgagccttccaaactgttccaacctctgcccatccaaagctgcttccacattttcaggtatcttttgtagcaatgccccacttctctgataccaatttcctatattagtccattctcacactgctataaagaactatctgagactgggtaatctatgaagaaaagaggtttaattgactcacaattctgcaggctgtacaggaggcatggctggggaggcctcagaaaacttacaatcatggcagaaggtgaaggggaagccagcacatcttcatatgatggcaggaactttatatgttatagaagttagccccaagaatgaaatcgtgtcctttgccaaaacatggatggagctagaggcctttatcctaagtgagttaacgcaggaacagaaagccaaatagtgcatgttctcactgataagtgggagctaaactatgggttcacaaaggcatgcagagtggtactgtggacattggagactcagaatgggggaggctaggagggaggtaagggatgaaaaagtacctgttgggtacaatgtacactacttgggtgacgatgggtccactaaaatcccagatttaaccactgtacaattcatccatgtaaccaaaacccacctgtaccccaatgctatgaaaataaataaaaccaaattagctctgtttctgttagatgagatgca

SEQ ID NO: 416126 - DNA, 2789 bp, Homo sapiens
  misc_feature (44)..(44): n is a, c, g, or t
  misc_feature (384)..(384): n is a, c, g, or t
  misc_feature (392)..(392): n is a, c, g, or t
  misc_feature (491)..(491): n is a, c, g, or t
  misc_feature (1017)..(1017): n is a, c, g, or t
  misc_feature (1539)..(1539): n is a, c, g, or t
  misc_feature (1838)..(1838): n is a, c, g, or t
  misc_feature (1843)..(1843): n is a, c, g, or t
  misc_feature (1898)..(1898): n is a, c, g, or t
  misc_feature (1970)..(1970): n is a, c, g, or t
  misc_feature (2492)..(2492): n is a, c, g, or t
  misc_feature (2716)..(2716): n is a, c, g, or t
gagacaggctttcactctgtcaccaggctggagtgcagtagccngatctcagctcactgcaacctctgcctcccgggctcaagcgattctcccgcctcagccttccgagcagctgggactacgggcgcccgccaccacgcctggctaattttttctatttttagtggagacggggttttgtcatgttgcccaggctggtctcaaactcctgagctcaggcaattcgcctgcctcggcctcccaaagtgctgagatttcagacgtgagccaccatgccaacaatcacatacattaaagttagatactccttggtgttttgagacatgcattttaaatttaagaacttaaaaaaatttaaagtattaataaaattttcatttaagnaagtagtntcccagattgatagactgatagactgtggtgtacaaaacacaaaaacaaaagggcttttttatatcgggagagagtgatgtaaatactcgcagcactcntctgtctcacagatgacagaagacacggatttattcagtttcattagatacatgtatctgagagagtggaactatgacaaaagcattttgcattttatattttcactgtgattctgagtcagttggagacattctgaagcattttattgcctggacttggcaaacagatggtgagatcataagttggggatttctcatcagtaagcagaacaaaccttgttgttcaggtccttctgggcttcaaatgacaggctctggtcattctccagggtgagcatgttgggtccaatgcagatggccagattgctggagtccatcctgttcacctcagagttcttgctgatgaggtgcagcacatagaccaagtgcttgagtagcaggaggttgggccgggggagcttatctgcaaccctggaataaagtgaagggatgttagttttcaaaaaggctaatggtcttcagtgtagcaagctgagagtttctgccgaaaccagacttcctttaaaatgaggaaggtgcattttcncaagtaatattgtgaaatgctcattcagacacttccagtggcaactgacacagagtgagactggttaaccacaaggtcttgaggagctaagaaactggcctttgtaattgggacaccaataacacagccctttattatttatacagagcttaaattatgaagccaatctgcattaaacaccatagtttgcctttatgtttagaaaatagttttgttgagtaatcatttagtcatgtagaatttctttctgtttctaacacgactagactggttttcttgccttaaaacaaagacggaaacaaaactataattaccaaacgaagatgacacatttttacaacattctgagaaagctttatgaagactaaatcagtttctaagggcatgttcatataaggcggcacttaaatcgcaacattgtttctaatgataagaaattagacttcttaaagtctcactttttcaaaaacgaaatggtgattattttcatttctcagaagaaggaattgttataaaaatgcnttatgtctaggtagaaactcattgtgataatcttagaattttcattttgggacagacattttaatgtcttcaattctatacatatgtcattgaaagtatttagccatgtgggacaattataacatttagataaactttcataggatgtgacaaccatgctgacatttcaaagcttgggttttagaattctctagtcactaacagatcacactttccattgcatatgttattatttttactctcactggaatgtgttattatatagttttcatttgggttaattataagaagatgaaatntgctntgaagttttatgaacaaaacaactgccccccaccacactgtctggctgcatcctnagggatgttttatgggagaactgttgccttgcatgacaccagtcagtgtagcttaaagataatcccgaattnctacactttgctggtgagcctgtgttaaagttctcaggtctgattttatctcatacctttttgaacatcttacattttcagacttccctacctcttgggatttgtgaggattgaagttcgctttctactttttgaagaaatatttcatttggctaaaattaaaattcaaaagtccagggcaccctctggtttttgttctgggagtggacgagcaattccactcggattccctaaacatcacaattctcatggaacagggatcatgaagcatttagaaagctgtgtaaagaatcaaaagacggaggtgatgtggcctggcaatgaccgatgactttgatgacttactgtttcagggcctcgattctgtcctcctcgtcctgcatctccagagcacccatccactcctcaaagaggtcgcttgaaagtagcttccgggggatacttctgaggaagtcctgggggatgagagtgggctgttggcctattggtactgtatgatgtcccatgtccttgttttcaccnggttttcgttccatcgcagggtgctctatgcttagcccatcatagattgtggcccttcattcctgcatttgatgaatccagggaaccctctctccaacacccttggcctctctgcaactttctaacatcaggcagagtcagaggcaccatccccaggtgggtgtgttctgaggggccactggattttgacgtatggattctgccacggaacaatcaaattgccngtacttggcaaagttttgggagagcagaatgcatcactttctgttggaatctgaggtcacagaaacagaggtg

SEQ ID NO: 416127 - DNA, 1682 bp, Homo sapiens
tctgacgttacgaaaatatcacccctgtccctcctggtcatctcactccctcctggcctgtacagtttccactgagaagtctgctgccagatggattggagctccttcatggggagtgaagccagcctgcttctatgctgccattttggaactcctgaaaaatattttcactggattagaattagagcttgatagttctttaaggacttgaaaaatattgtgccactttcttgtctccatgttttaggctgtacaggaggcatggctggggaggcctcagaaaacttacaatcatggcagaaggtgaaggggaagccagcacatcttcatatgatggcaggaactttatatgttatagaagttagccccaagaatgaaatcgtgtcctttgccaaaacatggatggagctagaggcctttatcctaaaagctacaaatcttcagcattctccactctgtgaagtcagaggaatggcgggaccatagctctgagctcattggcaaatacaactaatttcaatttctggaatggaagcagtcagatattcttctgactgcacgcgtatgtgggagtgccatgttgaagagtggaaaatatggaagatcagtccctacaaacttaataggagaatgacattcagatttcccgagtattttgcatgtccaactgaaaactgaagtaggtttatgagagaatgcacgcctacctggatgggtctggggagtgtgtcactgtcaccgcagataattgacaagggctgatcaaatagcgatgctttcaagtctgtctccaaagccccagaaaaatctgatgcaggggagagccttctcatgagaaagggccaggacagcaccttctttctcttcttaacttctacagccaagaaaacaaggcaacgagaaaaattagactacagtgttaagaagcaaagatccaggtaagaaaatgggtatcgttggccgcataatgtggtcaatagtatgcgatgtgagaaaaataattttgaaaacttgagaaagcaaagggcgtgaatcttaatctagaaaaaccaaccgataaacaaccacactgttaccagggcaaccagttccctaaacagcaacaccagagttcctcaaggcctccacctttcctgttttcactctttccagctgtttgctacagaaaattagcaaaacctaactgtgctgatcataaacaaccatcttaacctactggcctgaataactatagaggaaatttctgatatgaaatagattattttgatttcctcctttaactggcgaagaaaacgaaacttaaaaggtgaggaagtgacttgctgaatatcttttcgaaggcacatagcagggctggctccaaccctttgcagccacgcaggcactaaacagccactagagggagctaacaccatttttccttccaggtgactggtcaccttgggttttccaggttgctgctttaggacagaggcaaatacgaatcgctgcgggaagccttgaacctagatctggcaactgggaattatcagcaaaacgttatcaagatattctgtccttctgaaatccacaagatgtgtgtgcaatggatattgcaatctcaaacatttccttctttcttttcttttccttccttccttccttctcctttcttactaattataaaggctatattttctaaa

SEQ ID NO: 416128 - DNA, 557 bp, Homo sapiens
tctgacgttacgaaaatatcacccctgtccctcctggtcatctcactccctcctggcctgtacagtttccactgagaagtctgctgccagatggattggagctccttcatggggagtgaagccagcctgcttctatgctgccattttggaactcctgaaaaatattttcactggattagaattagagcttgatagttctttaaggacttgaaaaatattgtgccactttcttgtctccatgttttaggaatgactggaaattttaagaagttactatctctgctatggggatggatagtcagacagcaatgttcacaaattactcttgaaacttgatgcaaacaacctgtttaaaaactgatgtaacgagaggaatttcatggatgcaaatgaacacctgtgaaaattcttcggcaagaactgtttcatttagcaacaccaggttagcagtttgagagaggatcttttttgggtctacatgcccaaatttacagactgttttgctacttgaatctgccataatgtttgttgaataaataatctctatctttgaggga

SEQ ID NO: 416129 - DNA, 863 bp, Homo sapiens
tccttggcccggctttggaatgtggctttgcagggctggtgttggcgccattctcgcaggcccacgtgctcctgctcttccagggtgtcctcggctgtttctcctgccgcggcgcagcagcgctcccaggctgcccccgcgataacacgcccctggcagccaggctcccagctctgttacgtgcccgggcggggaagagcttcctggtgtctcccggctcctgcccttctcccgccccaggggcgggctgccgccgccctctgcagctgagtcagtgcagttcctcacctaccttctctgctcaccgctgtgtgctagcaatcggaggacccttggcacacggagcgacaggggcctcccccacagacacctcattttgggaaagaagtgagcaatttattgagtcttaaaaaatacaaaggcatagttccccttaatctatcaggcttccagctctaaagaatgtctctagtattgcggggtggggctgcgcttaaaaacgcagacgctttggttttagtaccagcaacgttaaaaatcttctatcttgtatgagtgaatgtgtatcccttgtgatcagttatttgcatttgcagttacaccttcattcagctaattgctgtcttgatttgaatccaggttctagaatgtactagctccgaaacctcaggcaagttaaatgtttttgtgcttcattttcctaatccacaaagtggcaatagaagaatttatctctttaggttgctgaggataaacgttatattagagtggctggaatgcagctttataagaatgacggcggcttgaaggtgaccaacaagggcttttagaccacctagggtgaccgcaagcgaaaccccctt

SEQ ID NO: 416130 - DNA, 979 bp, Homo sapiens
tccttggcccggctttggaatgtggctttgcagggctggtgttggcgccattctcgcaggcccacgtgctcctgctcttccagggtgtcctcggctgtttctcctgccgcggcgcagcagcgctcccaggctgcccccgcgataacacgcccctggcagccaggctcccagctctgttacgtgcccgggcggggaagagcttcctggtgtctcccggctcctgcccttctcccgccccaggggcgggctgccgccgccctctgcagctgagtcagtgcagttcctcacctaccttctctgctcaccgctgtgtgctagcaatcggaggacccttggcacacggagcgacaggggcctcccccacagacacctcattttgggaaagaagctgtacaggaggcatggctggggaggcctcagaaaacttacaatcatggcagaaggtgaaggggaagccagcacatcttcatatgatggcaggaactttatatgttatagaagttagccccaagaatgaaatcgtgtcctttgccaaaacatggatggagctagaggcctttatcctaagtgagttaacgcaggaacagaaagccaaatagtgcatgttctcactgataagtgggagctaaactatgggttcacaaaggcatgcagagtggtactgtggacattggagactcagaatgggggaggctaggagggaggtaagggatgaaaaagtacctgttgggtacaatgtacactacttgggtgacgatgggtccactaaaatccgatttatcccgggcaattctccggttacaaaacccctggtccccagcgttaaatatttacccattgttgttcgttaaaaagcaaattccccgcgattgtacgtcaagtgagggaacccgacaaattatcagtaataggcaatatatcgcgtgctcaaacgatgacgacccactatatatcataagatagtatcacacaccgagtg

SEQ ID NO: 416131 - DNA, 2192 bp, Homo sapiens
ttttcttttctactacatggcaggttgaaaattttccaagcttttatactctgctttccttttaaatataagttccaatatcaaaccacctcttcggaaatgcatatgagcatatgctgttagaagcagccaggtcacttcttgaatgctttgctgctttgaaatttcttccaccagatactctaaataatctctctcaagttcaaagtttcacagatccctagagcaggggcacaatgccaccagtctctttgctgaagcatagcaagaatgacctttactccagttcccaataagttcctcatctccctctaagacctccttggcctggacttcattgtccatatctcactatcagtattttggtcaaagccattcaacaagtctctaggaagttccaaactttcccttatcttcttgtcttcttctgagccttccaaactgttccaacctctgcccatccaaagctgcttccacattttcaggtatcttttgtagcaatgccccacttctctgataccaatttcctatattagtccattctcacactgctataaagaactatctgagactgggtaatctatgaagaaaagaggtttaattgactcacaattctgcaggctgtacaggaggcatggctggggaggcctcagaaaacttacaatcatggcagaaggtgaaggggaagccagcacatcttcatatgatggcaggaactttatatgttatagaagttagccccaagaatgaaatcgtgtcctttgccaaaacatggatggagctagaggcctttatcctaaggtgctctatgcttagcccatcatagattgtggcccttcattcctgcatttgatgaatccagggaaccctctctccaacacccttggcctctctgcaactttctaacatcaggcagagtcagaggcaccatccccagaagctacaaatcttcagcattctccactctgtgaagtcagaggaatggcgggaccatagctctgagctcattggcaaatacaactaatttcaatttctggaatggaagcagtcagatattcttctgactgcacgcgtatgtgggagtgccatgttgaagagtggaaaatatggaagatcagtccctacaaacttaataggagaatgacattcagatttcccgagtattttgcatgtccaactgaaaactgaagtaggtttatgagagaatgcacgcctacctggatgggtctggggagtgtgtcactgtcaccgcagataattgacaagggctgatcaaatagcgatgctttcaagtctgtctccaaagccccagaaaaatctgatgcaggggagagccttctcatgagaaagggccaggacagcaccttctttctcttcttaacttctacagccaagaaaacaaggcaacgagaaaaattagactacagtgttaagaagcaaagatccaggtaagaaaatgggtatcgttggccgcataatgtggtcaatagtatgcgatgtgagaaaaataattttgaaaacttgagaaagcaaagggcgtgaatcttaatctagaaaaaccaaccgataaacaaccacactgttaccagggcaaccagttccctaaacagcaacaccagagttcctcaaggcctccacctttcctgttttcactctttccagctgtttgctacagaaaattagcaaaacctaactgtgctgatcataaacaaccatcttaacctactggcctgaataactatagaggaaatttctgatatgaaatagattattttgatttcctcctttaactggcgaagaaaacgaaacttaaaaggtgaggaagtgacttgctgaatatcttttcgaaggcacatagcagggctggctccaaccctttgcagccacgcaggcactaaacagccactagagggagctaacaccatttttccttccaggtgactggtcaccttgggttttccaggttgctgctttaggacagaggcaaatacgaatcgctgcgggaagccttgaacctagatctggcaactgggaattatcagcaaaacgttatcaagatattctgtccttctgaaatccacaagatgtgtgtgcaatggatattgcaatctcaaacatttccttctttcttttcttttccttccttccttccttctcctttcttactaattataaaggctatattttctaaa

SEQ ID NO: 416132 - DNA, 2165 bp, Homo sapiens
ttttcttttctactacatggcaggttgaaaattttccaagcttttatactctgctttccttttaaatataagttccaatatcaaaccacctcttcggaaatgcatatgagcatatgctgttagaagcagccaggtcacttcttgaatgctttgctgctttgaaatttcttccaccagatactctaaataatctctctcaagttcaaagtttcacagatccctagagcaggggcacaatgccaccagtctctttgctgaagcatagcaagaatgacctttactccagttcccaataagttcctcatctccctctaagacctccttggcctggacttcattgtccatatctcactatcagtattttggtcaaagccattcaacaagtctctaggaagttccaaactttcccttatcttcttgtcttcttctgagccttccaaactgttccaacctctgcccatccaaagctgcttccacattttcaggtatcttttgtagcaatgccccacttctctgataccaatttcctatattagtccattctcacactgctataaagaactatctgagactgggtaatctatgaagaaaagaggtttaattgactcacaattctgcaggctgtacaggaggcatggctggggaggcctcagaaaacttacaatcatggcagaaggtgaaggggaagccagcacatcttcatatgatggcagggcctcgattctgtcctcctcgtcctgcatctccagagcacccatccactcctcaaagagggtgctctatgcttagcccatcatagattgtggcccttcattcctgcatttgatgaatccagggaaccctctctccaacacccttggcctctctgcaactttctaacatcaggcagagtcagaggcaccatccccagaagctacaaatcttcagcattctccactctgtgaagtcagaggaatggcgggaccatagctctgagctcattggcaaatacaactaatttcaatttctggaatggaagcagtcagatattcttctgactgcacgcgtatgtgggagtgccatgttgaagagtggaaaatatggaagatcagtccctacaaacttaataggagaatgacattcagatttcccgagtattttgcatgtccaactgaaaactgaagtaggtttatgagagaatgcacgcctacctggatgggtctggggagtgtgtcactgtcaccgcagataattgacaagggctgatcaaatagcgatgctttcaagtctgtctccaaagccccagaaaaatctgatgcaggggagagccttctcatgagaaagggccaggacagcaccttctttctcttcttaacttctacagccaagaaaacaaggcaacgagaaaaattagactacagtgttaagaagcaaagatccaggtaagaaaatgggtatcgttggccgcataatgtggtcaatagtatgcgatgtgagaaaaataattttgaaaacttgagaaagcaaagggcgtgaatcttaatctagaaaaaccaaccgataaacaaccacactgttaccagggcaaccagttccctaaacagcaacaccagagttcctcaaggcctccacctttcctgttttcactctttccagctgtttgctacagaaaattagcaaaacctaactgtgctgatcataaacaaccatcttaacctactggcctgaataactatagaggaaatttctgatatgaaatagattattttgatttcctcctttaactggcgaagaaaacgaaacttaaaaggtgaggaagtgacttgctgaatatcttttcgaaggcacatagcagggctggctccaaccctttgcagccacgcaggcactaaacagccactagagggagctaacaccatttttccttccaggtgactggtcaccttgggttttccaggttgctgctttaggacagaggcaaatacgaatcgctgcgggaagccttgaacctagatctggcaactgggaattatcagcaaaacgttatcaagatattctgtccttctgaaatccacaagatgtgtgtgcaatggatattgcaatctcaaacatttccttctttcttttcttttccttccttccttccttctcctttcttactaattataaaggctatattttctaaa

SEQ ID NO: 416133 - DNA, 696 bp, Homo sapiens
tctgacgttacgaaaatatcacccctgtccctcctggtcatctcactccctcctggcctgtacagtttccactgagaagtctgctgccagatggattggagctccttcatggggagtgaagccagcctgcttctatgctgccattttggaactcctgaaaaatattttcactggattagaattagagcttgatagttctttaaggacttgaaaaatattgtgccactttcttgtctccatgttttaggtaagaaatccactgccatttaaatcattgttctcctttagctaacgtgtaatttctttctggctaatttcaaaatgtttttttttttaattttcaaaagtttgatcttgatttgtctcgggtagatttctttgggtttatcctcttggggggtcacttggcttcttggatctgtaggccttttgccaaatttgtggaattttcaagcacgatttcttcaaatatttttccatctcatagttttcctcctctccttctaggattccaacaacatgaatgtaaatctttgtgattgttcttcagctctctcagccttttttttttttttttggtctattttctctctgttcagctggataacttccgttcttcattgattcttcttcaaatttactgactgtttcctatgccatttccaatgtactactgagtccatccagtgagtttat

SEQ ID NO: 416134 - DNA, 461 bp, Homo sapiens
agactgtttaaaaaaaattgcgtggggaagacagctgagacaaggatattaaataagaagacattttataagcctggccatttgaagatataggcttagaccagtagattgtaatttaaattttacttttttattttccaactctttaatctctaggaatgactggaaattttaagaagttactatctctgctatggggatggatagtcagacagcaatgttcacaaattactcttgaaacttgatgcaaacaacctgtttaaaaactgatgtaacgagaggaatttcatggatgcaaatgaacacctgtgaaaattcttcggcaagaactgtttcatttagcaacaccaggttagcagtttgagagaggatcttttttgggtctacatgcccaaatttacagactgttttgctacttgaatctgccataatgtttgttgaataaataatctctatctttg

SEQ ID NO: 416135 - DNA, 2157 bp, Homo sapiens
  misc_feature (712)..(712): n is a, c, g, or t
tggtcttgcacaagacttcagatagggccacaattatgggagctggaaagaatctggctcccttaccaccagtgggtcctttcccctgcctcacaggcatgcacatgctctctctgtaggtaaaaagtacagcatctggcttagcttcagatacttccagttttctaaagaccagtgctttgaatgctttttgttacttaggtaagctccatcaactgtaaaataagtattggtggatttatggatttcaaaaggcagaacaactaacatactgaattcctgattccagtctatgttctactggagttgtcagaatgccaaatgctaacgcaaacagtgcttttttcttctaaaaggaggaaagagggtgggaatgagaggatgaattcctatcagtttaggaggatgttgccattgggagttcttgcgtaatttgagattgtaaaacctagaaggtttcttgtctttgttatgtaggaggaaacaggaattcttggtttaacttaggctgggcctgggaggagtttgctgtttacaatgagatctaaccccttattggagatgattttaaaaatctctggccacctctatggccatctttggcaagatctgcatttggaatttaatagcaaccacatttattaaagcaaagaaatttccctcatttgttgtcccatgtagtccagtagtatgatatgcggggacatttttngccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416136 - DNA, 4579 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416137 - DNA, 4645 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggctgttttgacagaatacaaattaaaagcaattgaatatgtgcatggatacttttctagtgaacaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416138 - DNA, 4017 bp, Homo sapiens
tataatttcaagtactgaaatcttatagaaatgtttgcaaacatgctgtcattagagctgttagttctttgttttcaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416139 - DNA, 4876 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaatgacaaatattctgtgttttactaagtgcttggataggctttctaattttgtatacgtgctagagttaattattgaacatttttatccaaatttagttgtaactctgtttatactactgattgctcattcgtttaaatgatattttaatgtaaaagtcataaccaacatatgaacagacagatttatgtctttaaacacagaatgtaagctatagtttaatctgataccagttgctggaagttgccatttgtttttcttaaatctatacccataaaacttcttttaagattatattg

SEQ ID NO: 416140 - DNA, 3777 bp, Homo sapiens
tctacgagcggcattataccgttgacacacctcatggtatatttgcagccagtactctatatgaacaatccgtctggatcacggatgtaggaagtggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416141 - DNA, 3766 bp, Homo sapiens
tgttttttttagctgagctcccaatgttcagaatacttatcttttaagaatttttttcctacccctcttctttcttatattacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416142 - DNA, 4603 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaaaaaaaaaaaaacaagtctacgcgg

SEQ ID NO: 416143 - DNA, 4744 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaattatggtttgctaaaacaagaacaaaaaaaatttgcggcgcgcgcccccaaaaattctaaccttttgggccggccaggaaggaatggcagggtcagaaccgtccaagggggtctccaaaaacgggcggctgcacaaggcggtggtacagcggcccccgcggggga

SEQ ID NO: 416144 - DNA, 4503 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtacagactttattttttttttttttttttttttttttttttttttttttttttttttttttttttcccccccggggggggaaaaaaaagggggggatcctaaaaaaggagcagggggggggaaaaaaagggggggaggggggggtaaaaaa

SEQ ID NO: 416145 - DNA, 4429 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416146 - DNA, 3910 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgcctgtacagtctcctttagccactgctgcatcagcttccacgtcagcgccagttagctgtggctcctcagcctcccttttgcgtggcccccacccaggtacctcagatctgcatatttcatctacccctgctgcaacaactcttcctgttatgatcaaaactgagcccacaagtcctactccctcggccttcaaaggtccatctcattctgggaatccctctcatggcactttaggtttgtcagggacattgggccgtgcatatacttcaacatccgtgcccatcagtttatctgcttgccttaatcctgcattgtcaggtctctccagcttgagtactcctttaaatggttcaaatcctctttcctctatttcccttccaccacatggttcctccactcccattgcaccagtattcactgctcttccttcttttacttctttgaccaacaattttcctttaactggcaacccatctcttaatccgtcagtatctctcccagggtcattaatagccacctcatctaccgctgccacctccacatctctccctcatcctagctcaacggcagctgttctctcagggctttctgcttcagcaccagtctcagcagcacctttccccctcaacctgtccactgctgttccctcacttttctctgttactcaaggacctctgtcatcttcaaatccctcctatccaggcttttctgtctctaataccccaagcgttacccctgctcttccctcattcccggggctgcaggcgccctctacagtcgcagctgtcacaccactacctgtggctgccacagccccatccccagctccagtcctcccaggattcgcctcagcattcagttccaatttcaactccgctcttgttgcacaagccggtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtaaaaaaaaaaaaaaaaaaaaaaaaaaaaaaaaaaaaaaaaaaaaagggggggggggctaaaaatttcccccgggggggcccttttcgcgcaccccagctttttgggtgacacaaggggggcccccaaaaagggggacgcgatataatatacacaagagcacaggggggccgcgttacacaaaccggtgtaggccgggggaaaaaccgccctgccgcggggacccctgtggaaaagacaaccccaaccgcgggggggggcaccacgggggaccactccctacagaaattaaaacgccccggcggacaccaacatttcacagcggacaaag

SEQ ID NO: 416147 - DNA, 1731 bp, Homo sapiens
tatttataagacagcagaaaggattatatgcaaaacagacttactgaatttcgaataatatacttcacagtagaaagattcatatcagggaatggctgatttttatggtccttccaacagaggaataaattctaaggtttttgttttgtttttaacattttaagattgtatttgacaaatatggaaacagtagcttttatgtcttgtctgcagttaacttgtttttctgtcaattgttttagtttatcatctggacttcaagctgcaggcagttctgtttttccaggccttttgtccctcccgggtatccctgggtttcctcagaatccttcacaatcatccttgcaagaattacagcataatgcggctgcgcagtcagcattgttacagcaggtccattcagcttcggctctggaaagctatccagctcagcctgatgggtttcctagttatccttcagcgccaggaacaccattttctttgcaaccaagcctgtcccagagtgggtggcagtgaatacttttaacttttattctccttcagagcaacatcagaattgcctgagaactgcaatgaacaatctgacaaatgtgaagctggccaaaagtcggaaaatgagaatgagggtaatcctggagaaattgtgacaacaatttgaaaattgtggttgcattttaaagtgtgaacactcccctatgtaaatatgctgacaataaattgtatggagaatggtatttaaaaagtgtttggagacttttcacctgtcctataaaattttgaattgtgtatgtgatctacatagaaagaatattaaagagtaggttgaactctttatagccgaatacagccttaaatatgcttgtatagcatccactggcagaagtaatagttgtgcctcagacttgggggttgcatgtggccctgggggagttactacccttggtatgcatgagcggttcctattagcatcagtgggaactcagtactctgtatgtatccacaaaagggaacttgagacccacagttattcttaatttctgatattaacaaccgtacatactgctgaatttaactcaaaatatttcaggtaagtgaaagtggtgcttaatgtagactatagaatgactttcaggtgttttcaactgaaagtatatatccagaactgcatccttatagaaatacaagtaagacttaggataatttgccttcaaaacagttttcctaatctcagcagtatccagtgagtgaagaacacttgactgactcttgggccacctctgttacttactgtactatggaagctcctggtgaatgtttacaattatgggatgtagtatttctatttgtactttaagtcaaatgcttatatgaaatatgtgacaacaaatagagaagactggctctgttagtaattatgcagtatgtactctatttaaggatctgtggtagtataacatgagtgaatgtcattaattttgaagtaataactgccacatgtgggaagtaggggagtaaggagaatgaattccaatctgtgattaaaagtgtaaactatagactctactgtagtacatttcaggatctagaagttttacttttataaagatggtgtccggaagatgttgctaatgtattttacttcaacatagggaacaaactttttaagtatattaataaacctgtatggttagtttttaacagttttttaaaataaactatggatatgacaaa

SEQ ID NO: 416148 - DNA, 2340 bp, Homo sapiens
cctgctgccggggccgaggtatccaggagtcgggcggagcggctggggatgagcgcgagccggaccatgcgtccgggttcgcggcggtgagggtcgcggccggcggccgaggcgcaggtgcgggtcgagagaccggcgcctccctccccgccgcccgtggactctgagcgcaggtgtttctactctgccggccgctccacctgggaaagcgccttcaagagctacctctggcggcacctggccctcagctgcagggaaaccgcactcaaacctgccgccgagcccgggtttttctgcaaaactcagaggacctggctcttgcccgaggtgccctgaaccattgtgtgaataagctggggaagcctgactggagtgttttttctttttaataaaaagagtttttctgaatctcaatttttagaaattttttttgcgaagtttgcaatactctctacctcttcgcatcctctcttgctcgtggagtctttttcctcctcagctataaatattttttactatcggcggagcagaccagggatgaacgtcttttaattgcaagtataactgttaaaaccacgtcgggatagtagtcaagatggataaaaagtcctttgaaatggtgctggatgaaattagaaaggtggttgatttgctgagatatttttcctgggccgagccccagttgaaggcaatgaaagcattacagcataaaatggtggctgtccagccaacagaagtggtcaatatactcaactgtttcactttcagtaaagacaaactagttgctcttgaactgttagcctcgaacattattgatgcacagaattctcgtcctattgaagatttattcagggtaaatatgtctgagaagaaacggtgcaagagaatacttgaacaggctttcaaggggggctgcaaagctcctcatgctatgatatcttcttgtggaacaatcccaggaaatccatatcccaaaggaagacctagccgcataaatggaattttcccaggaactcctttgaaaaaagatggtgaagaatgtactaacgaaggcaaaggaatagctgcacgaattcttgggccatccaaaccacctccttcaacatataatccacataaacctgttccttatccgatacctccatgccgaccacatgcaactattgcaccaagtgcttataacaatgcaggtctggtaccattagcgaatgtcatagctccacctccacctccatatactcctaatcctgtaggaacagagaatgaagacctttcgaatccgtcaaaacctatacagaatcaaacattttccaccccagcaagtcaactcttttctcctcatggttctaatccttcaacacctgctgcaactcctgttcctactgcatccccagtcaaggcaattaatcatccatcagcatcagcagctgccaccgtttctggaatgaacctgctgaatactgtccttcctgtgttcccagggcaggtctcctcagccgttcacacacctcagccatcaataccaaacccaacagttatcagaaccccttcattgcccactgcacctgttacatccatccacagtacaaccaccactcctgttccttccattttttctggcctagtgtcactgccaggtccttctgccactcctaccgcagccactcctaccccaggacctacaccacggtccactcttggttccagtgaagcatttgcttctacttctgcacctttcactagcctccccttttccaccagctcttctgctgcttctaccagcaacccaaattctgcttcattgtcatcagtttttgcagggctccctttgcccttaccaccaacatcccaaggcctatccaacccgactcctgtaattgctggtggctctactcccagcgttgccggtccacttggtgtgaacagtcctcttttgtctgcgttaaaaggttttctgacatccaatgacaccaatttaatcaactcctctgctttatcctctgctgtcacaagtgggctggcttcactatcttctcttactcttcagaactcggactcttctgcttcagcccctaacaagtgctatgccccatcagccatccctaccccacagaggacttccactccagggttggccctgttcccaggcctgccgtctcccgtggctaactcaacttccactcccctgacattgctcttcccatccttcccccctcgcaccgcccctcagaccagctcctgcgcgcagcctcccccagcccccaacaccttgtcactggtccattgcttccccatcatactttctccattcaacctgcgcctcgagagatcctctagagt

SEQ ID NO: 416149 - DNA, 285 bp, Homo sapiens
agagcatttaactgtacttccagaaaaaggtaatttctggcatgaaaatttcacgttaaaaataaaattattttttatatcaacagaaaatggtggctgtccagccaacagaagtggtcaatatactcaactgtttcactttcagtaaagacaaactagttgctcttgaactgttagcctcgtaagtatttcttttttttttttttttttttttacttgggaaaaaatgtagaagcgttttaagtgtctaattagtgtgtgttaatgtgtctaacaaaatacagt

SEQ ID NO: 416150 - DNA, 586 bp, Homo sapiens
  misc_feature (267)..(267): n is a, c, g, or t
ataccaagatatgctgattataatacattaacaaatttataagttgcgttcactaaattctgtcctgtaactacaaaataatatagcttaaattgcatgttaattgtatatcttacctatttagtttatatattattcttacaatataatcatgtatattaacaaacagccctgggattctaatcttcctctgcaactgtcttccaggacttactggcacttattacactgtgataagtggcagaaaagtagatgaaatattctttntccattagatttgttcttatgtggacatagatatctacagtcattacattagccttagaatttagcatcatacttttaagcaccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaa

SEQ ID NO: 416151 - DNA, 3466 bp, Homo sapiens
tatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaa

SEQ ID NO: 416152 - DNA, 3412 bp, Homo sapiens
tatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaattttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaa

SEQ ID NO: 416153 - DNA, 2236 bp, Homo sapiens
  misc_feature (267)..(267): n is a, c, g, or t
ataccaagatatgctgattataatacattaacaaatttataagttgcgttcactaaattctgtcctgtaactacaaaataatatagcttaaattgcatgttaattgtatatcttacctatttagtttatatattattcttacaatataatcatgtatattaacaaacagccctgggattctaatcttcctctgcaactgtcttccaggacttactggcacttattacactgtgataagtggcagaaaagtagatgaaatattctttntccattagatttgttcttatgtgaccatgtaccaagccagctataaagtattgtataaagcgctttatacaatactgatagttattttatccacgtacaataaatcactcatttaattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaa

SEQ ID NO: 416154 - DNA, 3611 bp, Homo sapiens
tatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttcaaaataatatagcttaaattgcatgttaattgtatatcttacctattttgtttttatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaaaaaaaaaggggggtaatataggagggcagtagtcagttgaagggccaaagggttaaaaagggggacgggggaagcgggtgtgacactgggggatggacccacaacgaaaaagtgacgtggagtaaaaaaaacgaagtaatctatc

SEQ ID NO: 416155 - DNA, 3412 bp, Homo sapiens
tatgctaaatatattattagctcttaaattttagtatagatcgtattttttataaactattaccagtacagtagctagtagatattctgtgactgcctcattgtttatcttgctgctttggtccctatggctctagtatgaacattctcgtgtcttctgtggaaatgatttctgtgttatagttccatctttggtagaggtggggatgattgtattttgttttagttgacatcattctcaacttttagaaatactgttgaggaaaatgattaccgttggttttcaaattgacaactattttgcttccaaagacttcagtttccctttgttttatgtgtagacctcatatatgttcaacacattgcatactgccttgcacattgtaggaattcaacaagtcaagagttgataaaagctagaaagataaaactagcttagctatcatatcatcattgtccatattcttagctttgggaaaaatataccattttgcataaaatacataatcagtttcaaatgcataaggcaaagatatacagttgcacaacattgcaagtgaaatttacaaaggatttttatttttgtgtatgctaaaagtgctcctacttaaagcagttttctttattagaccaacaccttccagcaaagttagaaaccaaacacaagtgctcatttgcccaaattaaccagatagttatgtaaactgttcatattaagtctttagtggtttacaaacaataacattctggcttttcttccataccttttaggaatcagccttaattttaagtatagcagtcactttcctcaaggtactatgcagcatactttagattgcttatttatcattataaggtgataggtaataaatttgaggtttacttgtcatataatttcatatggcagatattgattcaaggagcattctattagaaaaagttgataaattatcctcccttacaaatatcatcttgcatttggagcaggtatttttttcttattagttaaagactgggtacagttatagtagatgctcaataaatgcttagtcagtgattgatctaacatcaaactaacagctttcagaaaggagactgttgacatcttttcaccaaggagtatatttgtagagtaatatatgtgtggaattttgaaattatatcatttgacatgatttatgaggcttatttaagctggagttagtaacgtaatagaagtattatttatacagaacatagttgaaagataggagatgtgaaagattaagtagtattttcttgtgcaaggcatattaataaatgtaattaaatgtcttaataagcagctggctgaactctagagagaactgctgtagtcttctgcaatcagtctctgtattggtatatccagtactatcgggtttaggttctttttatttttccttaaatcttacttgtttctagcgtcttaagagtggtaatggtaaaatgtgaagttacaataaacttctgcttgttttctcagaacatctttggcatgaggaagaactttttgtgaatgatacagtagtctcagcatctgttaatttgtggttttcaaagcatttttgacagagtttacctaatgtaaaaagattaaacagttttataaaacacaaataaacattcctacctgaactgtgaggaacagagtgtatagtacaaatgtaattaggcattgcctcctggcgaggttcttgatgcatgacttcgatgctggctgctgactgaggtgaccactgtcagtattgtactttggcatatgttgtttttaggaaaataatggaatgcattcttagattaacttactgtttttgagttggaaaaaataaaagatgaggtattataagtatgccaaatatttatacactacaaaagattaaaaaaggagagggagaaaaaaaaaaggccagttatgattttaatagcgtctaatttttttttgactcgaattttgtggacactagtcaattgcataatttaacatggaggagctttcatttaaaagaagttctcagctactatattctgccattaaaattaaccatgcctgttaattttacattgcttgaagatataagtaagctgccgtcaatattgttttaagattttcttatagtttatgtttaaatggaaaagttacatatataatctatggtgcagggtcaggcattggccattaaagataagtttggctaactattttactgaagagactaatggtcttccctctgttgtactgctatgtttcttgatctgtttttccccaatgtaacagtctacattgaagtcctttagctctctccatatactaattgacatttgttaaggattcaatattttgtgaattctttttacccttaaaatgcatatctttcagagagataagaatgaattttgcaataatttatatgcagagtgtgcttatgggtttctgggagttcaagttagtaccccagagtgcttaaaagtatgatgctaaattctaaggctaatgtaatgactgtagattatctatgtccacattgttcaacagaaatataatgtgaaccacaacataatttttaattttctagtagccatattaaaaaagaaacaagcaaaattaattttaataacagtttatgtaacccagtatattaaaaatatcatttcaacatgtaatcaatataaaagattattaatgaaacaccttatcttctttttcttccatactaagtcttagatttgagtgtattttgcactcacagcacatctcaattctgactggccacattttaagtgctcagtagtcacatatggctaagggctactatactggacagtacagattcatagagtataaaatatgactttaactttggagatggtgaggtaggcctgtaattatggtactttaaaaattcagaatatttagaaaagcatctaatagaattatccacttgttttccttcatcttcattttaatatgttctagaagtaggatcagcctgttccaatttgccaagcattattaaggaggaataattccataccatgtaaaataccatgatatgctgattatactacattaacaaatttttaagttgcgttcactaaattctgtcctgtttcttctatattattcttacaatataatcatgtatattaacaaacagccctgggattctaatcttcctctgcaactgtcttccaggacttactggcacttattacactgtgataagtggcagaaaagtagaatgaaatattctttttccattagatttgttcttatgtgaccatgtaccaagccagctataaagtattgtatttctgtagaatatggaaaatagtatttgtcttacctttgctaaatgtttgcaatttctaagtaaaccttttatctcctaaaa

SEQ ID NO: 416156 - DNA, 837 bp, Homo sapiens
ctaggcatgatgcagggaggacccagacctccaaattgggatatgaggttcagagaacagcctccctatctcccagcctggacttcagacttctcctcacctgctaaggtcactctcactgagtcccagcaagtctccttgtctcttctcttggtgggcatgccctggtctgaattactcttgggtacagccccctctcccgcaggcaggcaggctgcctctcaatgctttgcagggctcagcttgagaaggcatggcgggtcctgacagccaacaagaaccacactttcttgcctgatcttcagcgcccccacagtctggctcccatgtccctctttagccttgtgctcacctggcaacagcatctgcccaggccttccccaaccctcacggaccctcctgggtgggcccagcgtcagcctgggtaggctttccccgttctggggctgccatgctgccatgaaggtgttacatttgacaatactgagtttcactcagcaatggcctcttgtgtgcattttagttttctaagtacatcatcataagtctgcaagcaaggaccatatcctaaatttatctgacttccctacggtccccagtaggcacatgacggacaccactcagtggctgatgggaaagtcgaggcccagcttgggagacttctgacaatagggccacaggagatgccccccacccctggtggagtgttggagcagacagacaagctgccttcaaggacatgcattctctgatcattaggcttgtgccgcagatgaggtttcgtgggcagagttagcagagttctacgaagatgggctgccagtgaatgtttgctct

SEQ ID NO: 416157 - DNA, 832 bp, Homo sapiens
tagaccggactggggctcagaggggtttccatgactacgggactcctccgaccggtaccctgcagatgcttgtcagaaattggcttggaggccgggctcggtggctgacgcctgtaatcccagcactttgggaggccgaggcgggcggatcacgaggtcagaagatcgagaccatcctagctaacacggtgaaaccccgtctctactaaaaatacaaaaaaaaaaaaaaaaaaaaaattagccgggagtggtggcgggcgcctgtttgccccattacccggggggctggagcggcaggaaatagacgcgtggtgacacccggggaggcgggggttgtgcaaaatggacgccaagatcgcgccactgcactcccagcctgggcgacagagcgagactccgtctcagaaaaaaaaaaaaagaaagaaattggcttggagatttttcgccggccactccttcttgagccctgactgaaaagtgagttctcaatttgtgcttccagaaagtttgtcctcccagagtttgttcctggacagggctgaaggtactctgttccgtactagagtttcagattcgggctggagttggagagggtatgctgtggatggcagtagcagaaaccgctagttctaaggcacccttctactcttctaaaatctttccccaggcacaaaaccacccggaataaaggctacgttccctagcattccttgcagttggctgtggctctgtgattgcaatctggtcagtggaatataaggcagctttccctacttaagtgacagctggctgtactcttggttcctttttctccctttttcccagtgtgaat

SEQ ID NO: 416158 - DNA, 825 bp, Homo sapiens
gctgtttgcaagcaaaccagttgataatcaggctgtagaaagattctattatttcactcttccacactgaaaaacaaaaattacttgaaaaatttttgggtgcattttgcttactgacatttagtgggtcaaaacaaaaactatagtgcttcctgtattccatcgttcacactggtgactttgtgaggataaaaaagaacagagctgtcctctgaaaggaagagaaacccctaatctcatgttgcccagagcttttattttttgggacagcccagggatccaagacaaaggcctgtgcccacaggaaggcaaaaatacctggcaatgtgcttttttttccctattaggcctctaacatagtatctttttgttgttgttctaggcacccctcccatgcggggtctcttcccctggacaccttttcccttcccactattcctacccagggaacaaacagggtttcctgcacagagctgtgttattagagggaatgaatgttccatagttatttaatggtgtgccttgtggaaggcagagggaagtacttctctgtacgtgatttctatctttctaaaacctccgcaacacttccttcatgagcacacctactctagaatgacctcaaagtcagagatcctcaagagaagaagaaagaaatgattctataaaagatttatataagatatgcaagcagcttttatttttgctatgattaaatatgccctgtaaaatgctaaaataatttaaaaagttattttcaattttattggaaaatgatttctcttttattgagaatttacagtaaatgatcatctcttttctctc

SEQ ID NO: 416159 - DNA, 299 bp, Homo sapiens
ggagaggatcaagcaggcagagaggttcgcctaaatgcgctaggcccacgcggaaggtctttgggagttaaggaagtgtcagggaccctgcccaggggatattaggcgccttgagcaggacctggaaggtggacaggcgagggaaggagaacgttttcagcggcgccagcgcgcacctatggcctggctggggtgctaaggctgggctagactttctgtgctctctgccccctgcactcctctactctcccctgggaaggaccatggccacgccccacaaccccactgctccggcggcg

SEQ ID NO: 416160 - DNA, 2543 bp, Homo sapiens
tctcccaacaaggtggaggctgatgaatatgaactatctccagcccatcaccagctttttctttttcttcttgtccttatttgttttttagttctttataagaaaaagtgggggatatattgagaagtaccaagacggggagctatgggtttattgacaaaagagcataggacactgaaatagaaacgaagttattatttttctcttgtgatactctaagagaaaagctcttcctggaaaagccgatgatctctgaagatgctaaataaatgagcaggagtttccctgaaatggaggcgccctttgattggctgatctttccccgactcctgccaatcggagcatccctgggctccagctccataaacataagcaaagctacatgcttattcttctggacttggagtgtataccatttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416161 - DNA, 3629 bp, Homo sapiens
tagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416162 - DNA, 2877 bp, Homo sapiens
  misc_feature (931)..(931): n is a, c, g, or t
  misc_feature (1448)..(1448): n is a, c, g, or t
  misc_feature (2025)..(2025): n is a, c, g, or t
tagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagtaagttgatcttagcttctgacttccagcaaactctttgctctgcgtttctgctatatgtgattgtgggatattaatttttgaggttgactttagtgcaaagcaaaaggcttccagaatgtcctgacatgcagattctggattagcaggaatgcccctccgtagatttcccactgcagaggaggaagaccttattccaggcgaagggcaagcttgtctaacctgcggcccaggatagctttgaattcacaaattcgtaaactttctcaaaacattatgagttgttctgtattttatttagttcatcagctatcgttagcgtattttatgtgtggcccaagacattcttcttcttcctgtggcccagggaagccaaaagattggacacttctgctttaagatttgagtttggaggtcatcttaacaacttcngtgttacagctgggatcactcacctgtaccaattggttttacccacctactcacacatccacctaatgccatctgagcaaattcagacaacaaacaaagcaaacaaaaccaaagtcagttactttcctttaaagtcggttactttcctttaaagtcagtgtggctgggcgcggtggctcatgcctgtaatcccagcactttgggaggccgaggcaggtggatcaggaggtcaggagatcaagaccatcttggctaacacagtgaaaccctgtctctactaaaaatacaaaaaattagccgggcgtggtggtggacgcctgtagtcccagctactcgggaggctaaggcaggagaatggcgtgaaacctaataggtggagcttgcagtgagcagaggtagtgccactgcactccagcctgggtgagagagtgagactccatctcaaaaaaaaaaagaaaaaaaagaaaaagtcagtgtgtgtgtgtgtgtgtgtgtctgtgtgtgtgtgtgtgtgtgngagagagagagagagtttaagtattttgtagctttaatgggttattatgacaattcataaaaataatttagaaatattgaccacttcactgatccattgacagctgattctacataagaactttagagtcttctgaattaaagctgctaaacaagacgctacagtatatttagactattgtagctgatgatgtctctcttcttggtctttcctacttgcttggagatactttaggtagtaacattagcatatttaactatattattttacagtgcatttcattgctttcctaaaaaattatctgccccaaatacaccaagtgttactattttcactctgcatatgtgatgaaaactgtgtctaactatcattttcagtttccactgaagccatgtggtagactaaaaataaatttaaaaattgggaaaagcatctggctaaaattaagctgtgggtactgtaactaccataaatccttattgttgaaaattacattagtgtggcttagaaactcctaaacattttgcccaataacatcctgaacctaaaaacagtgatgagctcaatggagtgagtngctacagttggctgaactgtctttgatgcctgctttgctacttaatggagattataatctactcatttttcagtggctacatgatgagctgaggcgttttcgtctgactttgcattggtcttcttactcaagtcagcatgaatgaatgttaatttgacctttacaccattgttttatgtgttttttgtagtttctgattatcctgctaaaagtcatcatctgcttgctggacagaaaaagtagaccttgccttttatttcattttagagtctaaaagacagctttttaatcaaagccttctctaagccaaagaaggagttagtttcatttttttactgctgtggatttatgaacaaaaattccgcaatctaagtcactccttgagagaaggcttagatgttaggcagagtgaagtttttcagcatcccaaaagaaacttagcgtgacttgtcatcaggaagaatggaatttgtgttcttgagataatgatcctcacattcccagctcagtgaatggaaagatgtgaaagccagtgtaagaggcactattaaaagatgggagcagccgggtgcagtggctcacgcctgtaatcccagcactttgggaggccgaggcaggcggatcacgaggtcaggagatcaagaccatcctggctaacacggtgtaaaccccgtctctactaaaaatacaaaaaaaattagccaggcgtggtggcaggcgcctgtagtcccagctactcgggaggctgacgcaggagaatggcgtgaacccaggaggtggagcttacagtgagcagagatgacgccactgcactccagcctgggcaacagagtgagactatgtctctgtctc

SEQ ID NO: 416163 - DNA, 1010 bp, Homo sapiens
tctcccaacaaggtggaggctgatgaatatgaactatctccagcccatcaccagctttttctttttcttcttgtccttatttgttttttagttctttataagaaaaagtgggggatatattgagaagtaccaagacggggagctatgggtttattgacaaaagagcataggacactgaaatagaaacgaagttattatttttctcttgtgatactctaagagaaaagctcttcctggaaaagccgatgatctctgaagatgctaaataaatgagcaggagtttccctgaaatggaggcgccctttgattggctgatctttccccgactcctgccaatcggagcatccctgggctccagctccataaacataagcaaagctacatgcttattcttctggacttggagtgtataccatttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagaccaagttttggtatttgtcggctttttccccaaaatcacaaaagtccctgccttttccggggactttataaagagaggtccttcgtgggggaagaggccccccccaatttccttggcggggacaa

SEQ ID NO: 416164 - DNA, 717 bp, Homo sapiens
  misc_feature (656)..(656): n is a, c, g, or t
  misc_feature (694)..(694): n is a, c, g, or t
  misc_feature (701)..(701): n is a, c, g, or t
tagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagtaagttgatcttagcttctgacttccagcaaactctttgctctgcgtttctgctatatgtgattgtgggatattaatttttgaggttgactttagtgcaaagcaaaaggcttccagaatgtcctgacatgcagattctggatttaaggcccaaaanggggggaaaaaaaatttggggccccccccccccccccnttttttncccccccggggttttt

SEQ ID NO: 416165 - DNA, 768 bp, Homo sapiens
ctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtaaaaccttcttggcctctaactgagcagccctccatagaggattattagttcatgcctctgtgcaagaaagaaaaacaaaaacaaaatgcatgagttcattcactctcccatctcccctgctggcctgagagcacctgaacatagtgatggtactgtagccagtcatctgtgcatcctctgtgctctgcccactgcctggcatgtagaatatgcccagcaggggattttcagagctgaccagatgggagagtggtgaaactgaagatcagcccttttccctgcctgtaagcacctctaggaaaagatttaagagatgttgcaaacaaatcactccaacgtatttgggattgctcattgtgatgcctgatctgtgccagcctcttcctaccacatctatgactgttacaggggtaactgttccatcccttagtctgcagcacccggaatggatgtggaatcactgaaggaggtgagtggggaagaagacaagttggatcctgacagtttaaacccaggtgttttgcaaatccatcccttagtctgcagcacccggaatggatgtggaatcactgaaggaggtgggttggaaagaagacaagttggatcctgacagttt

SEQ ID NO: 416166 - DNA, 369 bp, Homo sapiens
aaaatgtcatcatgtttgattatttggaccttaccttgtagcacttcactcttgaggagggaaatcagatctctggtggttggtaaaatctgctgaagaattcaccttatcatgattttgttttactcacagaatcatgtcaaccctgccatggacttcacgcagactccacctgggatgttggctctggacaacatgctgtactttgccaagcaccaccaagatgcctacatccgggtaagcaagaagccccttttcagatattgtgtgtttcctactcaatgttaatttcaaactcacaaatacggagggattacctttagatgagtgaccccatattttctgtctttcttagtaaactaaaaaaaa

SEQ ID NO: 416167 - DNA, 3597 bp, Homo sapiens
ctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416168 - DNA, 3599 bp, Homo sapiens
cgttggctgtgcccctgcaccttcagcacccaggcaccaaggggagccgtttttcataccaaaccaccagtgaaaacaggaagtgatgaagcaaaattcaccctgcatctgcactgagtgacttctctttctttttctgtcattcctcattaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416169 - DNA, 3587 bp, Homo sapiens
  misc_feature (935)..(935): n is a, c, g, or t
  misc_feature (948)..(948): n is a, c, g, or t
  misc_feature (962)..(962): n is a, c, g, or t
  misc_feature (990)..(990): n is a, c, g, or t
cgttggctgtgcccctgcaccttcagcacccaggcaccaaggggagccgtttttcataccaaaccaccagtgaaaacaggaagtgatgaagcaaaattcaccctgcatctgcactgagtgacttctctttctttttctgtcattcctcattaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaaggcagatcangaaatccaaactnatatatgcaggatnatgcgctttccgaaggcccgatgagagnaggcgagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416170 - DNA, 2825 bp, Homo sapiens
attcaagggttcccatgatgtaggagactctgaattcaaaagactgcatgctttgcttgggtctgatccgatttgtagctgactgtacattatacttggacattggttgtcttgttaggattagtgtaaggagcagagttctgctttatttccctgggtgttgatgcatttcaagagaaaatgcttttaaagctacattaataataagagtcaaccctgtgtattgctaggaagagagaaaaaggtgcaggcacggagcccggagccgcttgattgtgttgctggtgtttgcattgtgaagagagatgttattacaatggtctgtcaaacacttcttcagacccccagccacggaatgaagcatctcttctccgtgtgccactgttctctgcttggaaaatgtgtaactgagctaggtcatgtcctttccttttatgaaacctgtctccaaattgaaatatgttttttaattaattgcaaagataaagtgaagtgcaattggaaagattttagcagtcaaaaagcatgcttcaaaatgactctattttgcatcctttcaaacccctgaaaaaccagagagggtttgcaaagttatattcaaggattggctctctgccaggaaagggatgctctgagctattgctctgctccctggggtttaattttctgacactggtgatgaaattttcaatttcgttgggtagaaacaggaagaacaagaaagcagtactataaacaggcaatggaggggcagcgtggggaacgagaaactctttgcctgtagggacccttctagctgcaaacttaaaaatgtatgtggcaagatgcaacccaagcaccgagcaggattccagacgagttataatcattctgaacggggagaggaaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416171 - DNA, 1737 bp, Homo sapiens
ctaagccccacctcataaaggagatgaaaacacttgctacatgggctgcatgcgaattaaatgagatagttcacagaccgccgtgaatggagagaaggaatcatgccgtgaaccttgaagagcatggttcctccttccatcagcctcattgcagctccgcttggctagacaagctggccctatgccatggtcaatgtgcagccatttgcaactgcaaaatgaaatgtgccgattttccttaaggtgctgttttctctcatctcttgtaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416172 - DNA, 1489 bp, Homo sapiens
ataaaaaaagaatggaggtgttgaaggcgggaagctccagcgtatggtaatgagtacaaagggcaagatgaagttcaatacgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416173 - DNA, 737 bp, Homo sapiens
gcgaattcactagtgattgtgagctgagatcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416174 - DNA, 1180 bp, Homo sapiens
ggtactgaggaacaggatgacgggcgtcggtgacacttcgggaaacagctataacggggcgcaggcttagagagggggaaatatgttatacgggggcgtgtgttttcacatgcgctatcatcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 416175 - DNA, 1621 bp, Homo sapiens
ctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattgtaagtaagctatctccagtatgcgctctccctccagcctccccgggcctgacctcagccacataactgatgtctcttccgagcgtgtggtcctcttgcgctttacggaatagtttccacatttccagatgtttagctggtttaaacaggatcacatgaaaatctcttctggcttcagtgaaatggaataacttgcacaagtgtgactaatactgcatttgtttattcagttctgattaagtgtaaccgagagtagttagcccggaatgtatctcgacttcattaaatctatttcacaagaaacttaagat

SEQ ID NO: 416176 - DNA, 942 bp, Homo sapiens
cgttggctgtgcccctgcaccttcagcacccaggcaccaaggggagccgtttttcataccaaaccaccagtgaaaacaggaagtgatgaagcaaaattcaccctgcatctgcactgagtgacttctctttctttttctgtcattcctcattaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaaggtaggtcatctacattatttaatatgggatacatattgaaggaaagtaaatcatgatgatgttttctttgttcgggcctagacatgcaggtctaaattttaggtctctactatccacgaaaatagagtctgtaaagcaaacaactgctactttagaatccacaagatgatatttgcctgctcaagagtaaagaccaaatatgtttcgtgtcttgtttagcaactgcagttgccttctaacagtgaatatgtctctcttactgcttggttaaagaatttatttgatacttaatgacttagttgggttttcctttctcagattttgttttttcaaagtagcctctaacccttgcttaaagtacgtgaaataatgacaagaaaccttttcaaatgtggaattatgtatgtaggcactaagagtgttctatgaatcttgggaacccagctctctccttgggtgattttaaatcttttttagcaagattaaaggagaaggagggatttgtgaagacagcaattcagccc

SEQ ID NO: 416177 - DNA, 1537 bp, Homo sapiens
  misc_feature (935)..(935): n is a, c, g, or t
  misc_feature (948)..(948): n is a, c, g, or t
  misc_feature (962)..(962): n is a, c, g, or t
  misc_feature (990)..(990): n is a, c, g, or t
cgttggctgtgcccctgcaccttcagcacccaggcaccaaggggagccgtttttcataccaaaccaccagtgaaaacaggaagtgatgaagcaaaattcaccctgcatctgcactgagtgacttctctttctttttctgtcattcctcattaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaaggcagatcangaaatccaaactnatatatgcaggatnatgcgctttccgaaggcccgatgagagnaggcgagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccgggtaagcaagaagccccttttcagatattgtgtgtttcctactcaatgttaatttcaaactcacaaatacggagggattacctttagatgagtgaccccatattttctgtctttcttagtaaactaaaaaaaa

SEQ ID NO: 416178 - DNA, 289 bp, Homo sapiens
gtaagttgcatttctttagtcttatggctatgtcaaggctaggaactttgtgtgcagagaacgccctctccttctattcggggactcattgggcctctctgctatcctggccacagatggactctccagagcagctatgttccgctgcacggctggcccgctggggtccttcccaaatccaggggcaagtgggtagagatggataagcccttgactgatgagggatgctaggagtgttccagcagtagagccttttcatgaaatgaaatgcaacctggaagcccagatg

SEQ ID NO: 416179 - DNA, 532 bp, Homo sapiens
attggtctcagggtaatggaaggtaggctaaagtcattttgctttaggaactgcattgtggtatatgttgggattggtccaattccaatcacagggtgcttagttcatccaacactaaaaaattgtaaaaatgaaaatggccactttcatttttctaatcagtatacgcttgtatttttaaggtggtctcttgccaaccatgaatattttgcactccagcatgccgatagttcaaacttctatatcacagaaaaggtaggtcatctacattatttaatatgggatacatattgaaggaaagtaaatcatgatgatgttttctttgttcgggcctagacatgcaggtctaaattttaggtctctactatccacgaaaatagagtctgtaaagcaaacaactgctactttagaatccacaagatgatatttgcctgctcaagagtaaagaccaaatatgtttcgtgtcttgtttagcaactgcagttgccttctaacagtgaatatgtctctcttactgcttggttaaagaatt

SEQ ID NO: 416180 - DNA, 895 bp, Homo sapiens
gatgtaaccatggcaggaaactgggtgaagagcacacagtacttttcaatatgatctctgtgtctttctataaatctatcatttaaaaaaaaaaagttggttttttaagtttctaaaatcttataaaatcgttggcatactcaggttaaagggatattttggggtgttcagttttgttttgcttttcgtcttgtgattttgttttttccatgttaaagttggttgaacatacagttattttaagtgcctgtgtattcttcataatttatggaatcaatagattttgctgtggattttctgccaccttgttacttcttttatttttttttcttcttagtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416181 - DNA, 2124 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416182 - DNA, 438 bp, Homo sapiens
tccaagtgatctggaagctgaggtactactttcaggatgaatggtccggggatattccgctgcagttgcttgaggaatggtttgcactgtgactggatcattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416183 - DNA, 735 bp, Homo sapiens
ggcacacaccaccacacctagcaaatttttgtaaaaaatttattgtagagatggggtctcactttgttgctcaggcttcaagccatcctcctgcctcagcctctcaaagtgctgagtttacaggcatgagtcactgcacccagccctcttcaaactgttaatcataaatataaaaatcacacaagaagcactcgaggaactcaagcttggaataagtggtaaaactttgtaatataataagcatgggactctattatggtaattaaatttctttaaaacaaattcagttgaatatattataacattgtaactgttacactacattattgattattggcctctcttaggaagaatatgaagaactgcttcattatgctatagtgactccaaatattgaaccctgtgcttcacagtcatctcatcctaagggagaattggtgccagatgtcagaatttctacaattcatgatattcttcatagtcaaggttatatatatttttcaagatatctcttaatttaaaatattactgagtttattaatgatactgacaggattgtgatctaggggagctttttacattttaatatattattcctgactctcgtgtgacagcttgattttctttgaacttcatttgactcttacttttatgaagaataataaagttgaagcaatgctatggcaactgcatggctttttggtatgttgtatctcagtacttgttccaacagtt

SEQ ID NO: 416184 - DNA, 2079 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggcttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416185 - DNA, 2026 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416186 - DNA, 2183 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcagaaaatattgatgaactcttcatacactctgtacaaaggcttcaaccaacacagtaagaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416187 - DNA, 1902 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggcttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416188 - DNA, 2327 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatactagtttatttgcatagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaaaccagctcctggattcattgattttttgaagggttttctgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgt

SEQ ID NO: 416189 - DNA, 1653 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcaggccaggcgcggtcgctcacacctgtaatcccagcactttgggaggccgaggtgagtggatcacgaggtcaggagatcgagacgatcctggctaacatggtgaaatcccgtctctactaaaaatacaaaaaattagccgggcgtggtggcaggcacctgtagtcccagctactcaggaggctgaggcagaagaatggcgtgaacccaggaggcagaggttgcagtgagctgagatcatgccactgcacttcagcctgggcgacagagcgagactatctcacaaaaaaaaaaattgttttttataatgcagtttttaataatgtaaagttcctaatgcatctgtcttgttagagcaaaataaatatt

SEQ ID NO: 416190 - DNA, 1985 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416191 - DNA, 1887 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416192 - DNA, 1975 bp, Homo sapiens
attcagtacaatctgctgcccaggacctggacattgacagataaaatgaagtgggtcagttaactacagagggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgctacaacttttcttttattcagagtcatcaccagtgttatcgccaaggaagccttctcacccagtcatggattttttcagttcacatcttttagctgactcttcctcaccagcaacaaattctagtcatacagatgcccatgaaatacttgtgagcgattttcttgtttctgatgaaaaccttcagaagatggaaaatgtgcttgatctttggagttcaggtcttaagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416193 - DNA, 1313 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggattttttcagttcacatcttttagctgactcttcctcaccagcaacaaattctagtcatacttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416194 - DNA, 1519 bp, Homo sapiens
agtttgatctcagactactgtgctagtaatcagtgagacttcgtgggcgtaggaccctctgagccagacaaacatcatatctgaactaagtaaatggagacttaattttattgactggcaccgaatggaaatgagaaaagagaaagaaaaacatgcagcacatttaaaacaactgtgtaatcagatcaatgaattgaaggagctgcaaaaaacctttgaaatctccattgggagaaaagatgaggtgatttctagcttgtctcatgccataggcaagcaaaaggaaaagatagagttgatgagaacattcttccactggcgaatcggccatgtcagagccagacaggatgtttatgaaggtaaactagctgaccagtactaccagagaactttactgaagaaagtctggaaagtctggcgttccgtagtgcaaaagcagtggaaagatgtggtagaaagagcttgtcaagcaagagctgaagaagtttgtatccagatttccaatgattatgaagccaaagttgctatgttatctggagctttggaaaatgcaaaagctgagattcaaagaatgcaacatgaaaaagagcactttgaagattccatgaaaaaagctttcatgaggggtgtatgtgcattaaatcttgaagccatgactatatttcaaaacagaaatgatgcagggatagactccacaaataataaaaaggaagagtatggtcctggtgttcaaggaaaagaacattctgctcatttggatccttcagctcctccgatgcccttaccagttacatcaccactgctgccatccccaccagccgccgtcggaggagccagcgcgactgccgttccctcagctgcttcgatgacttctaccagggctgcttccgcatcttctgttcacgttcctgtttctgctcttggtgcaggatctgcagctactgctgcatcagaagaaatgtatgtgccaagagttgtaacctctgcacaacagaaagcaggaagaactattacagcccggatcacaggaagatgtgattttgcttcaaaaaatagaattagcagcagtttagctataatgggagtttctcctcccatgagctcagttgttgtggaaaaacatcatccagtcacagtgcaaaccattcctcaagcaactgcagcaaaatatccccggaccattcatcctgaaagtagtacctcagcttccagatcacttggaaccagatcagctcacacccagtctctcacaagtgttcattccataaaagtggttgactaaagtgaatatgtccatagtggggtcttttaatccctctggtcttaccaagggttagaagtcttttggttttaacttttccatattgttagaacatcatggagacatcatgttcatctgttcaaaattacaagaggctttttcaagctctaccatgctttgtaactatatgtagaaattattttaatgttattttttatttaagcaattaagtaaaacttttttaaattaaaaaagaaa

SEQ ID NO: 416195 - DNA, 630 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaaaggatgtgatttccatatttcaagtcattcaaagacagatgagtcatcaccagtgttatcgccaaggaagccttctcacccagtcatggatttttacataaaattaacacaatcataatgatagggtttattttcttgattagtccagaagccagctgtccagggccagtgtatctacttgaggaagtcataaaagacaggctcc

SEQ ID NO: 416196 - DNA, 534 bp, Homo sapiens
ttaattcctccctgcagtttgaaactgtcaggttgccgtctaggtagcggttgtgcttgctgaggctgcacttgctgacactgcagctgcgacgcggctaagaggcgcagagcgaggagtcgggatttggtcgcgagcggcgacgagcatttgtgcagaatgtcatcagatgaggagaaatactcacttccagttgtgcaaaatgactccagtcgaggcagttctgtctcttcgaatcttcaggaagaatatgaagaactgcttcattatgctatagtgactccaaatattgaaccctgtgcttcacagtcatctcatcctaagggagaattggtgccagatgtcagaatttctacaattcatgatattcttcatagtcaaggaaataactctgaagtaagagaaactgcaatagaagttggaaagggtaagccatagaggcatatagggttttcacctataatataacttcgacaaagttatgtaatattttactaatacctcgatatcgagaaagacatagtagagacagga

SEQ ID NO: 416197 - DNA, 373 bp, Homo sapiens
ggtccttgctgcaactgcaagccactgaagacaggtgtgtctgatcccaacgtggagcccacagtaacagcaagcagcgactgttgcttgtgcaggaggccctgtgtgccacatgttgctcttcactactgatcagggctgtttacgtgggtcccacacagctgctctgtgactagggaacttgacgtctccatttttcaactgaaaacacagaagtacaaaggggttcaccaccttgtccacggttgccctgcttctaactggtcatgttggaataaaaacaagcaactgtcatccgggatattaaccacgcaggctgtggtgttgcaaagcaggggagcacggagcagggagcataccaccctgctgagat

SEQ ID NO: 416198 - DNA, 416 bp, Homo sapiens
taacgtacttctaagttgtaaagcctaagaaatttatgattgcaaatcttgtcaaatgataacatcaaagttgataaagaaattgacttcctagctgtttagtactagtactatacaactgacagtttttaaatatagaacatcaggagccaagtttatttccagctacaatgaaagtgtacttaaatacttcctatatatactttatatatttttttaaaaagcttgagttttaaagtttattcatgaaagatttgttccatttttttgtgaaagtttaaatggtacttactgcattatttaataatgaaacattttcagaatagtctaaagagcttaaaccttttttctattttgaagtcatctaaaacattttctaagaatttatcttataaataaaagttagaattcattta

SEQ ID NO: 416199 - DNA, 801 bp, Homo sapiens
actgagagctgtttggcactgaggtggagttggggaaggggtgggcagggtgggcatggcgtttccagtagtctcttccagaagagtcctaagcgattgctagggaacagatctaaagcacccagtttattcttttttgcacaaagcagcatgtctgaggcaggctgagtaaaacattcagagtatggtgaacagatagacttacatgaggcctgaaataaatacattttgaataattcattttctggtcacgaaattctagttgaaaagcaaaattcacatcttgccctgcctccatgatgactaggcacattataccacagtcagaaatgaaaactaaaacacacatacaaacaaaaaccatttcattaatggatgaactaaaacaaactgaacaagaacccaccagtccccaaatcaatgaaggctttagtgctttccctgaagttgccaacttcctaggaaaagtgaatcatgactcctgcagtactgatacctacagttaggtacagactcatgcaaatatgataatcattagagaaaacaactgtttttttccctattgctgacaggcggaatacaactttggaaaccctgtattgtgagtgtttattttcctttacatacctgcttcaaaccgtgttcagagagacagtttttcaagactcccttataaatagtttgcttgtgtaaacaagtatgcaatctttttcttaatggttttatctctcaattgtcatttaacaatggccaagtgatatatatacaaagagagagcattaatttataaacaaaaaaaga

SEQ ID NO: 416200 - DNA, 487 bp, Homo sapiens
tgcactccaacctgggcaacaagagtgaaactcagtctcaaataaaataaaataaaaatctacttttgaggaattcaaagtatacatgatcagtttgccaaagatttagtaaagacatttttatttaactgagtgtatctcaaatttattgtggaattctcagtccgaatatctggaataggaacagctttgttagatgctaccataaccacaatgaatgtcttcaagggtgtaattttagatatggtgagtggttgtgttgggggcggcataagtcagggcaattttttgcagctcatatcatgctctgaaagtagctacctgctttaatggatggttagtgcttttctatagaatggaaaagattccagcccgatccttgatatgtttgtgttaaacatgcttatatattatattaaacaatgattaaggacataaatgagtttctgtggtaataaagatgctatattgaatatcaatttgtgta

SEQ ID NO: 416201 - DNA, 728 bp, Homo sapiens
tttgtctcttgctgcagctggtgctccaaatctggtcttagctgcttcgtgtcttcttctccagcctctgtggccctgtgacctgcaggtattgggagatccacagctgagggacccccggaagcctagaaatgggaccattggaatttagagatgtggccatagaattctctctggaggagtggcattgcctggacactgcacagcagaatttatatagggatgtgatgttagagaactacagacacctggtcttccttggtattgttgtcactaagccagacctgatcacctgtctggagcaaggaaaaaaacccttcactgtgaagagacatgagatgattgccaaatccccagttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacataagataagagatactggaaaaaaacctttcaaatgtatagaatgtggcaaagctttcaaccagtcctcaatccttgctacacataagaaaattcatatctcggtaccg

SEQ ID NO: 416202 - DNA, 937 bp, Homo sapiens
tttgtctcttgctgcagctggtgctccaaatctggtcttagctgcttcgtgtcttcttctccagcctctgtggccctgtgacctgcaggtattgggagatccacagctgagggacccccggaagcctagaaatggtattgttgtcactaagccagacctgatcacctgtctggagcaaggaaaaaaacccttcactgtgaagagacatgagatgattgccaaatccccagcgccgcgcggtgaggttctctagtccacgctcgcagccatgccgtccaagggcccgctgcaatcggtgcaagtcttcggacgcaagaagacagccacagctgtggcgcactgcagacgcggcaatggtctcatcaaggtgaacgggcagcccctggagatgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaaaagttcattagctttttatgaaggatttatccttttttttcagtgtgctgtttattgctgagaagtggctgccctgccagaaaactgctattctcagctgtaaccacattgactaatagtgagtggaagtgcagtggataaaaagcaaatgtgt

SEQ ID NO: 416203 - DNA, 998 bp, Homo sapiens
tttgtctcttgctgcagctggtgctccaaatctggtcttagctgcttcgtgtcttcttctccagcctctgtggccctgtgacctgcaggtattgggagatccacagctgagggacccccggaagcctagaaatggccaggcgcggtggctcacgcctgtaatctcatctgctcggccaccctgtcccggccctgaagcgatgtaagcaagaagctgccctgctggaactgctccttcgggagactgctgattttggcattctttttcctttcatcgtatttcctctttttttttttttttgagatgaagtttctctcttattgcccaggctggagtgcaatggcacaatctcggctcactgcaacctccgcctcctgggttcaagcgattctcctgcctcagcctcccgagtagctgggatttgcccaccaccatgcctggttaattttgtttgtaaatgtaacctgtatttatcagaatctagcaattgaagtaatgtgttcttattgtttctttcagttatgtgttttcattttgcccaagatgaggttaattttgtttgtaaatgtaacctgtatttatcagaatctagcaattgaagtaatgtgttcttattgtttctttcagttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacataagataagagatactggaaaaaaacctttcaaatgtatagaatgtggcaaagctttcaaccagtcctcaatccttgctacacataagaaaattcatatctcggtaccg

SEQ ID NO: 416204 - DNA, 1189 bp, Homo sapiens
tttgtctcttgctgcagctggtgctccaaatctggtcttagctgcttcgtgtcttcttctccagcctctgtggccctgtgacctgcaggtattgggagatccacagctgagggacccccggaagcctagaaatgggaccattggaatttagagatgtggccatagaattctctctggaggagtggcattgcctggacactgcacagcagaatttatatagggatgtgatgttagagaactacagacacctggtcttccttggtattgttgtcactaagccagacctgatcacctgtctggagcaaggaaaaaaacccttcactgtgaagagacatgagatgattgccaaatccccagatggagtccactttctcatccaggctggagtgcagcagcgcaatctctgtgtgatcattgcaaccttcacctcccaagttcaagcgattctcctgcctcagtctcccaagtagcaaggactacagcgccgcgcggtgaggttctctagtccacgctcgcagccatgccgtccaagggcccgctgcaatcggtgcaagtcttcggacgcaagaagacagccacagctgtggcgcactgcagacgcggcaatggtctcatcaaggtgaacgggcagcccctggagatgactgagccgcgcatgctacaatacgagctgctggagccagttctgcttcttggcaaggagcgatttgctggtgtggacatccgtgtccgtgtgaagggtggtgctcatgtggcccagatttatgctatccgtcagtccacctccaaagccctggtggcctattaccagaaatatgtggatgaggcttccaagaaggagatcaaagacatcctcatccagtatgaccggaccctgctggtagctgatccccgtcgctgcaagtccaaaaagtttggaggtcctggtgcccgtgcttgctaccagaaatcctaccgataagcccatcatgactatcaaaattcacctgtataataaacagtttttgagggattttaaagtttccaggaaaaaaaaagttcattagctttttatgaaggatttatccttttttttcagtgtgctgtttattgctgagaagtggctgccctgccagaaaactgctattctcagctgtaaccacattgactaatagtgagtggaagtgcagtggataaaaagcaaatgtgt

SEQ ID NO: 416205 - DNA, 401 bp, Homo sapiens
gcggccgcacagagaagcaggtccacgaacgagtgtgcggcggggatggggtctctctccagcagacaggccacgcggggactcagccgcacactcgttcgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416206 - DNA, 2939 bp, Homo sapiens
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416207 - DNA, 5301 bp, Homo sapiens
  misc_feature (1487)..(1487): n is a, c, g, or t
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcggtcagggccccgggacgcagctggggggcctgggtgggcaactgttttcctcggataacgcccagggatgtcccactggcagccggagactctctgaggacatggcctgcagtgaagcggcaccggggtgaccctggaaccctcatggggaaaggcctgtcttgggctgggcgcctccagtgccggagccatggcagtctcagccaggcctcgaatggggttttgagggtgggggagtaatttttctctctggggtctccctttctcccgtgttcagttcttccgacggcagcctgtgggagacagtggcgcgggctctgagctgcctgggtcccacccacatgggacccctggctttggggatcctgaagctcgagcactggtatggtctggggtgcatttcattccgaggcgggtgctgggagctngggcaggcagggaggttgagagcgcagccctcatggcaggggagttccggacaccagggacagtcaggcggccgtgcggggtgtgactgggtggtgcgtgggttgcgcgcggcagcttctgaaggttctttagcaacagaataattgtttcagaccaaagctctgcgagatccccagaggtgagaaggatgcgggagctgctctgctcagagcagggtggtcctgccgacgccctgcgctccgctgccctcccacctgtcccccaccgcagctttggttgggggtttcggagctccccagcacacacaccatgcgggtggggggcctgggggcggtgcaacggcagagcctggggtcaggacaggtgggaaggccgtggatggcctgccagtgttccaggtgggctcacaataggggtggaagtgacctcaggacctgctgcccacagggcccaggggtaccatgagggtccagctctgagctccggggtctccgaatgtttaggagagagtagaccgggggaggatggaggaacaggcccggccctgcaggaatgcattgtggggacactgcctccacctaggcccagacgtgagggcaggtccctcccacagagtggacgctgtacacacctggggacacccgggaggctgggggcaccccatccctgtccccctgagcgggcactgcccctctctctgggtgcatggccaggccctcctggaggcccctcagtatctgctcctaaggacatcaggagtgtcaggcccatctccttggtcaggcctgtcctccccgccactctgtcccatggcatcccctggccagtggcctgcagagaatgtttctcggggggtgtcccaaccccctggctgatttgccccaggcttgctggggacattaggagcacagccaacttgtctcgcagccagggtcgcggcactcacctcgcgtttgtctccagtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggtacggtggtggggatagagagcgaggagaggagggaggcagaggcagtgggacccacccctgactccaccccgtcccgtgcaggcctctgcggatggggccttcacacagggccacagagctgctgctcagagagcttcacgatgcaggtggctgcatggggcgggcccagggcctcttgttggtgaagatacatcagcacgcaggggtgtgtggggccgtggggagcaggggcactggtcaggcggcctgcggggaattctggacaagggaaatgaggtggcaccaagacggccctgggcgtgggctttgggttctcctaagcgccatttgtgaatgtgcctactccacagcccctcacggagctgggccctggcaggtacagaccttgtgccacctgccgctgagcagacagcagacaactttggaggaagggcccagggcttcttgggatcctaaggaaaaggtgccctgcgtaattggtcatgttttgatgtagaaatcccgttgcctgggttgtgggtcttctggtgagggctgccaccacctcctcctgctcacagtctgggaagccggttctgcagcatattctgccctattaaaatcagcccaggaggggcgtggggctcacagctgtgattactgtgcgttggggggccgaggtggggggatcaatggagcccaggacttttgaggccagcctgggcaacatagcaagatcccatctctacaaaaaaatagaaaaattagccccaggagtatagctcaggggtagagcatttgactgcaaaaattagccaggcgtggtgatgtgtgcctctagccccagctactcatgaggctgaggcaggaggactgtttgagcctgggaggtggaggctgcagtgaactgtgattgcagtccagcctggatgacacattgagaccctgtctctaaaaaagaaggaagcccagcgttcccttctctctccacttcctgtccccattgctgtccctggagtacgggcagcacaggtgaaggcgagggggacagacagacagcctgcccctccgtctcccgtggccctgcagcccaccctatctgctccaggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416208 - DNA, 4705 bp, Homo sapiens
  misc_feature (3757)..(3757): n is a, c, g, or t
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcggtcagggccccgggacgcagctggggggcctgggtgggcaactgttttcctcggataacgcccagggatgtcccactggcagccggagactctctgaggacatggcctgcagtgaagcggcaccggggtgaccctggaaccctcatggggaaaggcctgtcttgggctgggcgcctccagtgccggagccatggcagtctcagccaggcctcgaatggggttttgagggtgggggagtaatttttctctctggggtctccctttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggtacggtggtggggatagagagcgaggagaggagggaggcagaggcagtgggacccacccctgactccaccccgtcccgtgcaggcctctgcggatggggccttcacacagggccacagagctgctgctcagagagcttcacgatgcaggtggctgcatggggcgggcccagggcctcttgttggtgaagatacatcagcacgcaggggtgtgtggggccgtggggagcaggggcactggtcaggcggcctgcggggaattctggacaagggaaatgaggtggcaccaagacggccctgggcgtgggctttgggttctcctaagcgccatttgtgaatgtgcctactccacagcccctcacggagctgggccctggcaggtacagaccttgtgccacctgccgctgagcagacagcagacaactttggaggaagggcccagggcttcttgggatcctaaggaaaaggtgccctgcgtaattggtcatgttttgatgtagaaatcccgttgcctgggttgtgggtcttctggtgagggctgccaccacctcctcctgctcacagtctgggaagccggttctgcagcatattctgccctattaaaatcagcccaggaggggcgtggggctcacagctgtgattactgtgcgttggggggccgaggtggggggatcaatggagcccaggacttttgaggccagcctgggcaacatagcaagatcccatctctacaaaaaaatagaaaaattagccccaggagtatagctcaggggtagagcatttgactgcaaaaattagccaggcgtggtgatgtgtgcctctagccccagctactcatgaggctgaggcaggaggactgtttgagcctgggaggtggaggctgcagtgaactgtgattgcagtccagcctggatgacacattgagaccctgtctctaaaaaagaaggaagcccagcgttcccttctctctccacttcctgtccccattgctgtccctggagtacgggcagcacaggtgaaggcgagggggacagacagacagcctgcccctccgtctcccgtggccctgcagcccaccctatctgctccaggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcaggtaggaggtggcaggttcctcagccagcaactcccgcctggccatcgtgtgtgctcgtttgcttgcgggtggtcgagcggccagcatgcagcgtgggagcagctgctgctgtgggcagcgcctgcagcagtgactgccgaggccctggggctgtgctgggtgtgggacctgtgcgcttcgccttctgtctccccagcacccctccacttagacatggttacctccatttgacagatgggtaaactgaggattggagggccgtgtgctcactgcgcagcatgggaaggtgtcagagcgggctgtggccctagactgcatgtccggggccagcccccatcatgtaccggagtcctgttgtgggagcctcgctcctgccacnccaccaaccatccgcacttgctccctgtcccccagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416209 - DNA, 2791 bp, Homo sapiens
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcaggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416210 - DNA, 4029 bp, Homo sapiens
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggtacggtggtggggatagagagcgaggagaggagggaggcagaggcagtgggacccacccctgactccaccccgtcccgtgcaggcctctgcggatggggccttcacacagggccacagagctgctgctcagagagcttcacgatgcaggtggctgcatggggcgggcccagggcctcttgttggtgaagatacatcagcacgcaggggtgtgtggggccgtggggagcaggggcactggtcaggcggcctgcggggaattctggacaagggaaatgaggtggcaccaagacggccctgggcgtgggctttgggttctcctaagcgccatttgtgaatgtgcctactccacagcccctcacggagctgggccctggcaggtacagaccttgtgccacctgccgctgagcagacagcagacaactttggaggaagggcccagggcttcttgggatcctaaggaaaaggtgccctgcgtaattggtcatgttttgatgtagaaatcccgttgcctgggttgtgggtcttctggtgagggctgccaccacctcctcctgctcacagtctgggaagccggttctgcagcatattctgccctattaaaatcagcccaggaggggcgtggggctcacagctgtgattactgtgcgttggggggccgaggtggggggatcaatggagcccaggacttttgaggccagcctgggcaacatagcaagatcccatctctacaaaaaaatagaaaaattagccccaggagtatagctcaggggtagagcatttgactgcaaaaattagccaggcgtggtgatgtgtgcctctagccccagctactcatgaggctgaggcaggaggactgtttgagcctgggaggtggaggctgcagtgaactgtgattgcagtccagcctggatgacacattgagaccctgtctctaaaaaagaaggaagcccagcgttcccttctctctccacttcctgtccccattgctgtccctggagtacgggcagcacaggtgaaggcgagggggacagacagacagcctgcccctccgtctcccgtggccctgcagcccaccctatctgctccaggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416211 - DNA, 2982 bp, Homo sapiens
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttctttaaccctttttgagttaatttaataataatgatctgagacaaggg

SEQ ID NO: 416212 - DNA, 3119 bp, Homo sapiens
  misc_feature (2171)..(2171): n is a, c, g, or t
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagatgggtaaactgaggattggagggccgtgtgctcactgcgcagcatgggaaggtgtcagagcgggctgtggccctagactgcatgtccggggccagcccccatcatgtaccggagtcctgttgtgggagcctcgctcctgccacnccaccaaccatccgcacttgctccctgtcccccagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416213 - DNA, 2566 bp, Homo sapiens
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416214 - DNA, 1688 bp, Homo sapiens
cttcctggcttggcccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcccctatgccgtggccctacccgaggtggccccagcccagccactcaccgaggcactgagggctctctgccacgtggggctctttgacttcgccttttgtgccttgtttgactgcgaccgccctgtggcgcagaagtcttgtgacctccttctcttcctgagggacaagattgcttcctacagcagcctgcgggaggccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416215 - DNA, 2537 bp, Homo sapiens
  misc_feature (2316)..(2316): n is a, c, g, or t
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggccctgcagctcctccaggaccctgagagttatgtccgagcgagtgcagtgaccgccatggggcagctgtccagccagggcctgcacgcccccaccagccctgagcatgcagaggcccggcagagcctgttcctggagctcctgcacatcctctccgtagactcggagggcttcccacggcgggcggtcatgcaagtcttcactgagtggctgcgggacggccacgccgacgcggcccaggacacggagcagttcgtggccactgtgctgcaggcggcgagccgggacctggactgggaggtccgcgcccagggcctggagctggccctcgtgttcctgggccagactttggggccgccgcgtacccactgcacccagccctgtattcttatttcttcaggatatttattttntcttttcacctgttttaaaaataaaaccaaaagtatttgattaccaacaaaaacaacacaaacaaaccaccgaaccaacgaaaacaccaagaaaaaagcgaaaaaacaaaagaagggggcgcgcgggcggcaaggaccccacgaggggaggggccccgcgggggcacacgcggcggggggagggggcccagggggcggggggggcggggcgcggcgccggg

SEQ ID NO: 416216 - DNA, 2076 bp, Homo sapiens
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggtgcggtcgacaccatcttctccctgcagggagactccagcctgtttgtggcctcggcggccagtcagctcctggtgcacgtcctggctttgtccatgcgaggtggagccgaggggcagccctgcctgccggggggtgactggcccgcgtgtgcccagaagatcatggatcacgttgaagagtccttgtgctccgcggccacccccaaggtcactcaggccctgaacgtcctgaccacgaccttcgggcgctgccagagcccctggacggaagccctgtgggtgcggctgagtccccgcgtggcctgtctgctggagagagaccccatccccgccgcacactcgttcgtggacctgcttctctgtgtggctcgttctcccgtgttcagttcttccgacggcagcctgtgggagacagtggcgcgggctctgagctgcctgggtcccacccacatgggacccctggctttggggatcctgaagctcgagcactgtccacaggcactgaggacccaggccttccaggtccttctccagcccctggcctgtgtcctgaaggccacggttcaggcccccggacccccaggcttgctggacgggacggcagacgatgccacgacggtggacacactcctggcctccaagtcgtcctgcgccggcctcctgtgccgcaccctggctcacctggaggagctgcagccgctgccccagcgcccttcaccgtggccccaggcgtctctactgggggctacagtgactgtcctgcggctctgtgacggctcggctgcccctgcctccagtgtggggggccacctctgtgggaccctggcgggctgcgtccgggtccagcgagcagccctcgacttcctggggacgctgtcacaggggacaggcccccaggagctggtgacgcaggcgcttgctgtcctcctggagtgcctcgagagccccggctccagccccacggttctgaagaaggccttccaggccacgctcaggtggctcctgagctcacccaagacccccggctgctctgatctcggccccctcatcccgcagttcctcagagagctgttccctgtgctgcagaaacgcctgtgccacccctgctgggaggtgagggactccgccctcgagttcctgacccagctgagcaggcactggggaggacaggctgacttcagatgcgcactcttggcttcagaggtgcctcagctggcctccgtgttccctgggcccagactttgggccgcgtgttaccactgcctatgcggtggcctcccgaggtggccagccaaccatcaccgagcatgggctcctgccatgggctttagatcctttgctcgtgcctgaccgctggggcaattgaacccttcccgaggacatgtcag

SEQ ID NO: 416217 - DNA, 1182 bp, Homo sapiens
  misc_feature (5)..(5): n is a, c, g, or t
  misc_feature (68)..(68): n is a, c, g, or t
  misc_feature (75)..(75): n is a, c, g, or t
  misc_feature (100)..(100): n is a, c, g, or t
  misc_feature (111)..(111): n is a, c, g, or t
  misc_feature (116)..(116): n is a, c, g, or t
  misc_feature (118)..(118): n is a, c, g, or t
  misc_feature (124)..(124): n is a, c, g, or t
  misc_feature (133)..(133): n is a, c, g, or t
  misc_feature (137)..(137): n is a, c, g, or t
  misc_feature (145)..(145): n is a, c, g, or t
  misc_feature (205)..(205): n is a, c, g, or t
  misc_feature (215)..(215): n is a, c, g, or t
  misc_feature (235)..(235): n is a, c, g, or t
  misc_feature (266)..(266): n is a, c, g, or t
  misc_feature (282)..(282): n is a, c, g, or t
  misc_feature (303)..(303): n is a, c, g, or t
  misc_feature (308)..(308): n is a, c, g, or t
  misc_feature (317)..(317): n is a, c, g, or t
  misc_feature (321)..(321): n is a, c, g, or t
  misc_feature (334)..(334): n is a, c, g, or t
  misc_feature (368)..(368): n is a, c, g, or t
  misc_feature (387)..(387): n is a, c, g, or t
  misc_feature (417)..(417): n is a, c, g, or t
  misc_feature (420)..(420): n is a, c, g, or t
  misc_feature (480)..(480): n is a, c, g, or t
  misc_feature (532)..(532): n is a, c, g, or t
  misc_feature (539)..(539): n is a, c, g, or t
  misc_feature (544)..(544): n is a, c, g, or t
  misc_feature (563)..(563): n is a, c, g, or t
  misc_feature (688)..(688): n is a, c, g, or t
  misc_feature (704)..(704): n is a, c, g, or t
agttntgattctctccgccagcactttatgagtttttaactggagaacttgaactggccctggcgctngttttgnacaaggtggctctggccccccccgntcttgtggttncctgnangcattntttccatcnatantatccccngctccacgtcgtccttttcacctcttttcctcgtacccccgcaccccacaggatcctagnaatgtcttgnagcacagtcgcaggcggggnagagaatgaactcgggccctggggccagagnagttgctaagagcctntaaagccataactgtgggganagtgnacttgagcngctngcgggagaagatngctcggggtgtggctggggccacctgggggaatngctctggggaggaggaggnagaggaggatggcccagcagtcctggtggngcngcacactgattcagcaatggagccaatctgtgcccacccaagagcgctacaaggatgggntggtgaccctcggctgtgtgggtgttcccttatgtgggaaagtcctcgctgntcaatgngctgntggggcgaaaagtctttantatctccagaaccccggcccatacccgaaactttcatacctactttcttaccccctcttttaagctctgttactgcccaggcctcatcttcccatctcttctgcctaggcagttgcaggatgctngcagggatctaccctntcgcccagagccaggggcagccccaacactgcctccgcagaggccaccctgccgaggtggcgggcgggtgagcaggcccagcccccaggggaccaggagcctgaggctgtgctggccatgctcaggtccctagacctggagggcctgcggagcacgctggccgagagcagcgaccacgtggaaaagagtccccagtccctcctgcaggacatgctggccacgggaggcttcctgcagggggacgaggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416218 - DNA, 918 bp, Homo sapiens
ggcgggggtgatctgtcggagcgaccggcttggcgcctgcctgtccccagcccctctcagcttgaactccttccttcaagtctgggccctcgaggcttccagagcggcctccaggggtgcagtctcagttccccacgccagccgtctccgtcctccgcctcctccgggcctggcaggtggcactgtccggaggcggagccttgggcgaggggtggttgcggcggaggacgcaaccgagcgggcctgcggcctcaccatggacccagaatgcgcccagctgctcccggctctctgtgctgttctggtagatcccaggcagccggtggcagatgacacctgtttggagaagctcctggactggtttaaaacggtcactgaaggagagtccagtgtcgtgctgctgcaggagcacccctgcctggtggagctgctgtcccatgtgctgaaagtccaggacctgagttctggggtcctctccttctcactgcgcctggcaggaaccttcgcagcccaggaaaactgcttccagtatcttcagcagggggagttactaccagggctctttggggagccaggacccctcggccgagcaacctgggccgtccccaccgtgcgcagcggctggatccagggcctgcgctccctggcacagcaccccagcgccctgcgcttcctggccgaccatggccgactgctactgagcagaaccagagtctgccactggggctcaggaccaagggaggcagcaccatgtccttctgtgggacactgccagccccagggctccagcccagcccggtggatcctctggggaagccaggaccaggagagaagcaaggtcaagaaatcccacagtttgatgtattaaagaaatgacttatttctactcaaaataaatggcattgaagtctttcttta

SEQ ID NO: 416219 - DNA, 1036 bp, Homo sapiens
tttttttaacagtatgaatttcctcttatagcaataatggatgagatttaaatgacagctttctcacattcattatggcatacagtgccccccaaccaagtcatcttggatgtgttgataaaagatttctcaatattcattatactcataagtactctcctctcatgcaaattctctaaaataacactagtgaaaatggtagctaatatttgtggtatgctacgttcaaggcaccattctaagagcttttacatgtaataacttacataatacttccaagaatcttacaataaaggtaatatacttaggtctatcttaaaatgattaaaccaaggtagaggttaagtatcatgatacatataacaaaaagatcaactagtagagctaagataacgttgaaaaagatatttgttttcaatatggctaaagggcttcctacatttactatattaaaactattctccaatttgctaatgtttaataggtttccagtaatgatgtttttctatatgaatgacactaccattttctctcacataaattatctgatgctgtgctttatgaggcaaatgtgcgcccatattcacatttgtgagaattctttgctgctaacaaccagagaacctcttcatagtgatctcaaataatcagacaattcacatgtaaacttgtgagccatgactaaagtcaatcccacattccttatattcaaaagatttctcactgatatgaattctctgatgttgagttagctgtgaaccacgagtaaaggccttcccacattccttacattgatatggtttctcaccagtatgaattctctgatgccgagaaagatgtgaactctgagtaaaggcctttctacattctctgcattcatagggcttctcaccagtatggattctctgatgtagagtaagctgagagccatgactaaaggccttgccacactccttgcattcatagggtttttctccagtgtgaattcgctgatgttgagtcaactgtgaaccacgaataaaggctttcccacatt

SEQ ID NO: 416220 - DNA, 319 bp, Homo sapiens
gcggaccatgctggcaccttaccttggactttccagcttccagaactgggttcaacaggatggtcttgggatcctaggcatcatggagggctgaagaaacatcaaggggagccccagaaattcaccacgggatcccagcctcaggcccgcctagacagtgtgcggggcttctcaccagtatggattctctgatgtagagtaagctgagagccatgactaaaggccttgccacactccttgcattcatagggtttttctccagtgtgaattcgctgatgttgagtcaactgtgaaccacgaataaaggctttcccacatt

SEQ ID NO: 416221 - DNA, 660 bp, Homo sapiens
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 416222 - DNA, 487 bp, Homo sapiens
  misc_feature (44)..(44): n is a, c, g, or t
  misc_feature (47)..(48): n is a, c, g, or t
  misc_feature (50)..(50): n is a, c, g, or t
gccgggagcgccagcccgggcccgccaggataggtattttgaanggnngngtcggtttgggacaaccacaatcatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 416223 - DNA, 688 bp, Homo sapiens
  misc_feature (661)..(661): n is a, c, g, or t
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaanaaaaaaaaaaaaaaattctccagggct

SEQ ID NO: 416224 - DNA, 781 bp, Homo sapiens
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgtcagagtgtgaagaagggcaaactgtggcttttctgtggtttgctgttggggcagctagctgctgattcctgggaaggaatttcaattctttccatgtgctcagagagaagaaggcatttgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 416225 - DNA, 635 bp, Homo sapiens
taaacagaccctattagactcagacccacgagcacaaagctagctgcaacgactctcttattttccaccgctacactcgggtgccccattctcttctttacacactcctgactggctcagcggaaggagctcctgccactcctctaacagcatctgaccttccccgccgccccgggaactggactctctgaagtatacagaaaagtagcgattccttaaatatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 416226 - DNA, 944 bp, Homo sapiens
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaacaaaaaaaaagaagagagagagagagagagagagagagagaagacaaagaacagacatagaacaaggaggagaggcgagagagcgagaaggagagcggcggccgaccgaccgcgtgtggatgcgggcggcgacggcgggtggccccgacgggggggggcggggcaagcgggcagcgcgcgcgcggcgagcggga

SEQ ID NO: 416227 - DNA, 1089 bp, Homo sapiens
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgtcgggtgccccattctcttctttacacactcctgactggctcagcggaaggagctcctgccactcctctaacagcatctgaccttccccgccgccccgggaactggactctctgaagtatacagaaaagtagcgattccttaaatatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaacaaaaaaaaagaagagagagagagagagagagagagagagaagacaaagaacagacatagaacaaggaggagaggcgagagagcgagaaggagagcggcggccgaccgaccgcgtgtggatgcgggcggcgacggcgggtggccccgacgggggggggcggggcaagcgggcagcgcgcgcgcggcgagcggga

SEQ ID NO: 416228 - DNA, 606 bp, Homo sapiens
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 416229 - DNA, 2824 bp, Homo sapiens
cagcggcggcccaggctctgggcactcgcgcggctcccgttcgcggagcacacagtcccggcgcgacgaggttccttcggagagcgagcgggagtcggtgctcggcctcctgcggggagcagcccgaggaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccagggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcct

SEQ ID NO: 416230 - DNA, 2180 bp, Homo sapiens
cagcggcggcccaggctctgggcactcgcgcggctcccgttcgcggagcacacagtcccggcgcgacgaggttccttcggagagcgagcgggagtcggtgctcggcctcctgcggggagcagcccgaggaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggc

SEQ ID NO: 416231 - DNA, 1682 bp, Homo sapiens
atgccatggtgtccctctgcccctcctcccaagctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccagggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcct

SEQ ID NO: 416232 - DNA, 2337 bp, Homo sapiens
cagcggcggcccaggctctgggcactcgcgcggctcccgttcgcggagcacacagtcccggcgcgacgaggttccttcggagagcgagcgggagtcggtgctcggcctcctgcggggagcagcccgaggaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggtccgtgctacaagcctgctagggatgtgctgggtcttcagacacccagagcaaggcacttcctggagccaggacagattctggcttagccttgctgttgtcctgaggaggtggcaggcaaagtggccttatggtgtgcccctaacagtgtgcccggggtatggggtggcagcaggaggaggggaacttcccttccatctgcctctcttagaccttctcctcagcacagccttccttccttcccctggttccctttcacaaggcccctcctgggtcctgggtcctgggtgtgaatcctggctctgcctccttccagctgtgcaaccttggacaagccatcagatcatctgagtttccatttcctttcctttaacgttgggatagagtttctttctcaaccaatgtgtggttatcattggcatgctaacatctggaaaagggtaaagcccttcagaagtgtaaggggattttaaggtataaaatgcttggctgaaaacctccatggtccattctggggagttgaagtcaaaactgaaattgtgaaaagccccaatcatagcttggtcccctttatcctcaggattcctcccctgacctgacactctgctaacttctgatggttttgggggcagaaacaggatgagatctgaaaagaggaggcccactgtttaaagccctctctgggctgggctcagtagttcacacctgtaatcccagcactttggaaggccgaggcaggtgggtcacctgaggtcaggtcgagacagcctgggcaacatggtgaaaccccgtctctactaaaaatacaaaaaattagctgagtgtggttgtgggcccctgtaatcccagctgcttgggaggctgaggcaggagaattgcttgaacccaggaggtggaggttgcagggagtcgagatcgtgccactgcactccagcctgggcaatgagagcaaaactccatctcaaaaaacaaaaaaacaacaacaaaataaagccctctctgtagaggatgcggattgcaggcaggcccttcagtccttttgcccaagcttgcttttttgtggctttgggtgccaaccttcttgtgctccagagcaagggtctgggctttctgggtagtggagaggccaggaggtgatcttttgggccctgctgtcctggtccgactgcattcttcctttgttgggcccctggcattgggctacagggtctctgtagatgagggtgaagggagctcctagaaagctgggcatggcctgagactggggagatggaagcaaagagggaagtattaatcagagaccagccccaaatcaggcaggaaagaggcaaaggaaaccgaaatgggttgttcagatgacccaggagaaaagcaaggaagggagccctctggggccgtagcggtcaggagggatggagaattggaattcaacacgtagtgtccttgggttctcatggaaagtcttccgtccctttgacttttgaaaatacagttaccaacccgccactgctaaatttgaactggcttaaaaataataaaaatactaaaaaatacaaaaatgt

SEQ ID NO: 416233 - DNA, 2994 bp, Homo sapiens
agcttccacgccgctgtttcttcatcaataaaatgggaacattcgcagtcatttctcaggactttgtgcagacaaaaagtttatcatagaaatcaccccacacaatgcttggcacatcgaggacactcagcacatcttagctttatttccttcctctctgaaaaaagtaagcagagttatttgttcccatcctctctgtccacagcctggtctcagagaacacagtagatgtgtagtcagtttgttcaataaatatgcttgatggagcttcaatacccacctccacccccttctcccagaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctggtccacgttggagatgagctccgagaagtgaacgggatcgcagtcctgcacaagcggcccgacgagatcagccagattctggcccagtcccagggatccatcaccctaaaaatcatcccagccacccaggaggaagatcgcttaaaggagagcaaggtgttcatgcgcgccctcttccactacaaccctcgggaggaccgggccatcccttgccaggaggcgggcctgcccttccagcgcaggcaggtcctggaggtggtgagccaggacgaccccacgtggtggcaggccaagcgagtcggggacaccaaccttcgagccggcctcatcccctccaaggggttccaggagagacgactaagctaccggagagccgcgggcaccctgccgagcccccagagcctcaggaagcccccctatgatcagccttgtgacaaagagacctgtgactgtgagggctacctcaaagggcactatgtggctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccagggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcct

SEQ ID NO: 416234 - DNA, 1761 bp, Homo sapiens
agtcagttagcagagtggttaagggtataagctgggcatttggcagagagaccgattctggctgtgctctctactggttgtgggtcactgtgcacagtgctgaacctctccgtgcctcagttttctcagctgcaaaaggaaaagcctccttttgcctacatcaaagagttgttgtgtgaatcagtgatacgcctgcctggaaaggcacagtgcctgatacagggacatgcaatgaggtggaagtgcctggtttagacacagcagcagtgaactcccaaatgagtgcctaagcctgctgctgtccctgcgtgctgtgatgtgacatctctttgcccagctttccttctttctttaaaagataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccagggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcct

SEQ ID NO: 416235 - DNA, 1683 bp, Homo sapiens
ttgaggctcagagagatgaagggacttgtccaagctggtcttcggaggagcttccggctgggctgtagggagagactgggtggctcgcaggaaggaaagatgtcctccggagctgagtctccggagctgctgacttacgaagaggtggccaggtaccaacaccagcccggagagcggccccgcctggtggttctgatcgggtctctgggagcccgactgcacgagctgaagcaaaaggtggtggctgagaacccacagcactttggcgtcgctgttccacataccaccaggccccgaaagagccatgagaaggaaggagtggaatatcactttgtgtctaagcaagcatttgaggccgacttacatcacaacaagttcctggaacatggtgaatataaggaaaatctgtatggaaccagcctggaggccattcaggctgttatggccaaaaacaaagtttgtttggtggatgtggagccagaagcactgaaacaactgaggacctcagaatttaaaccctatattatatttgtaaagcctgcaattcaggaaaaaagaaaaacgccacctatgtccccagcttgtgaggacacagcagccccatttgatgagcagcagcaagagatggccgcttctgccgccttcatagaccggcattacgggcacctggtagacgccgtgctggtgaaggaggatctccagggtgcctacagccagctcaaagtggtcttagagaagctgagcaaggacactcactgggtacctgttagttgggtcaggtaactttatcccagaacatccaagctggacgggaccttgaagatcatctagtccagactccctcattttaccatcaaggaatctcaagcgcagagagggagagaattctccacaaattccatcatcgagaagagtataagtgggaagtcttgtttgttgttggtttttgtctgttgtttttcactgcacctctttggatcatgatttgaaaggggcatatcagaaaacaacacatttcatttattaaagtatcacaggcaagctgaccctgattctttgtaccaaagttaagtagccactgtcttttgtgggtggtagtggttaatttatacagtactgattcgcagaatgtttaagctttttaaacatagtgacgcttagtagtttttttggaagctaacttgttttatccagggggattttacatgtaactgaagttcccctgtcttcaagcactaaaacgttgatcttaaccttttttttgaagtgcttgcctggtaatagaaaacgggttctctgcctattttaaaatagtgaatatacgtaaattttctctggaaggctgaggcacacttcaccatcaacatgaattactgtactatcctgtactgcagtggtgccttcagggactcgaggaatgtaaggttgcctttcccctttctaaataccctcagattcctaacatcgagcccatgctttgtttgatttgttctattccatccattgtcccttttgttactgacagttgccttggtcctagccagtccctgccatgagatcataggggttcccattgtgctagatcttgggaaaccagatgactctccctgtcaaaactatggctacgtcactgtaaaccatttctgtcaagaataaaagtatgtagacccagagtgtgggcct

SEQ ID NO: 416236 - DNA, 998 bp, Homo sapiens
cagcggcggcccaggctctgggcactcgcgcggctcccgttcgcggagcacacagtcccggcgcgacgaggttccttcggagagcgagcgggagtcggtgctcggcctcctgcggggagcagcccgaggaatctgcagggagaggtcgggaggtgacaacgccagcatgccagtgctatcggaggactctggtttgcatgaaaccctggccctgctgacctcccagctcagacctgactccaaccacaaggaggagatgggcttcctgagggatgttttcagtgaaaaaagcctcagttacttaatgaagattcatgagaagcttcgctattatgaaaggcaaagtccaaccccagttctgcacagcgctgtggccctcgctgaggacgtgatggaggagttgcaggccgcctccgtgcacagtgatgagagggagctgctccagctgctgtccaccccgcacctgagggctgtgctcatggtacatgacacggttgcccagaagaattttgaccccgttctcccgcctctgcctgacaatatcgatgaggattttgatgaggaatcggtgaagatcgtccgcttggtgaagaacaaggaacccctgggtgccaccatccggcgggacgagcactcaggggctgttgtggtggccaggatcatgcgaggaggcgcagcagacaggagcggcctgagactggggagatggaagcaaagagggaagtattaatcagagaccagccccaaatcaggcaggaaagaggcaaaggaaaccgaaatgggttgttcagatgacccaggagaaaagcaaggaagggagccctctggggccgtagcggtcaggagggatggagaattggaattcaacacgtagtgtccttgggttctcatggaaagtcttccgtccctttgacttttgaaaatacagttaccaacccgccactgctaaatttgaactggcttaaaaataataaaaatactaaaaaatacaaaaatgt

SEQ ID NO: 416237 - DNA, 368 bp, Homo sapiens
ctttaaacatgcaagaactcagagaatactgtactcataagccctactagattaggaaattttgacccaccactttcagttcaagacatgtcaggtggacaaaaacatagtaaatatatagaagaagacctaagaaagcaaaatcagtaagatagatcctttttaatgtattataatagtaattattaataatattttaacttttagtttcaggggtacatgtgcaggtttgttctataagtaaattttgtgtcaagggagtttgatatacagattattttgtcacccaggtaataagcatagtacctgataggtagtttttcgatcctcatcttcctccactctccaccctcaagttggtcccggtg

SEQ ID NO: 416238 - DNA, 918 bp, Homo sapiens
accagcccagcctttcagtgcaggctccagccctccacccccacccgagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtcaaaaaaaaggagaaagagaggagatcttagttaagagccgaagcttatccgttagtggggtaatttagcgtggaatgcgtcgtttaaagtggtcttggaagctgtgcgtaccgcttatgcctgaggaaccctttgcactggtatagaaagccgcgattccttcacagtgcctgaatggatggcgccttagcgtatcggggttgtgtgcgaccggaattgcgggcggcctggtttgcttctctggggccaaaaaggctggtgtttcgcgacaatgggggtccgcagttttgggttggtctaaccctttagtgcggaaaagaaatggggctagaaaacttccttt

SEQ ID NO: 416239 - DNA, 576 bp, Homo sapiens
accagcccagcctttcagtgcaggctccagccctccacccccacccgagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtca

SEQ ID NO: 416240 - DNA, 1372 bp, Homo sapiens
gaggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcaggtggactttccagacccagctggtgacgccagtgccccctaaatcccagaggtggccccttccctcgtgccctggccgcagcccctgggatcccgcggacccctggcctggcggtgcaggagtggtagcaggtccgcgcgccttcttgccggcggccggcgctgctcagcggcgcggctggactgagccgctcccgctgcgctcagagtccgggcccctggcgccatgccaggcccggcgggcgtgcgcccggcgcgcagcactgcagcgctggtcatatgagcagaaatgatgagaaaagcactttttaatcttttcgcacttgctctgcccgctcaaacagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtcaaaaaaaaggagaaagagaggagatcttagttaagagccgaagcttatccgttagtggggtaatttagcgtggaatgcgtcgtttaaagtggtcttggaagctgtgcgtaccgcttatgcctgaggaaccctttgcactggtatagaaagccgcgattccttcacagtgcctgaatggatggcgccttagcgtatcggggttgtgtgcgaccggaattgcgggcggcctggtttgcttctctggggccaaaaaggctggtgtttcgcgacaatgggggtccgcagttttgggttggtctaaccctttagtgcggaaaagaaatggggctagaaaacttccttt

SEQ ID NO: 416241 - DNA, 486 bp, Homo sapiens
ccgggctccctcagccctccaatggagctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtca

SEQ ID NO: 416242 - DNA, 354 bp, Homo sapiens
ctctagaggatccttcccgaatagcccgattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtca

SEQ ID NO: 416243 - DNA, 1080 bp, Homo sapiens
gaggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcaggtggactttccagacccagctggtgacgccagtgccccctaaatcccagaggtggccccttccctcgtgccctggccgcagcccctgggatcccgcggacccctggcctggcggtgcaggagtggtagcaggtccgcgcgccttcttgccggcggccggcgctgctcagcggcgcggctggactgagccgctcccgctgcgctcagagtccgggcccctggcgccatgccaggcccggcgggcgtgcgcccggcgcgcagcactgcagcgctggtcatatgagcagaaatgatgagaaaagcactttttaatcttttcgcacttgctctgcccgctcaaacagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactgagtagcaactctgtgcccggcaatggaagagaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtca

SEQ ID NO: 416244 - DNA, 737 bp, Homo sapiens
gaggctgaggtaggagtggagagagaaagggagcagggcctaggaggtcctgaggtgcaggctggccgctgaaggttcaggatcttcccccacgcggcaggacatccgccaaggttcccagatctgagacggcgcacctcctgcgtgtccttgacggcagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgatccagcagatgttgactgagtagcaactctgtgcccggcaatggaagagaattctccactctggtggctgaaagctaagaagcactgactgcccctggtcttccacctctctgccctgaacacccaatctcggcccctcttgccaccctcctgcatttctgttcagttcgtttatgttattttttactcccccatcccctgtggccctctaatgacaccattcttctggaaaatgctggagaagcaataaaggttgtaccagtca

SEQ ID NO: 416245 - DNA, 820 bp, Homo sapiens
gtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggaatttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaa

SEQ ID NO: 416246 - DNA, 402 bp, Homo sapiens
gacaccaggaggcgcattgatggttacagattcctccaccctagctttcaactttgcttttgccctcttcacccttcccaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaa

SEQ ID NO: 416247 - DNA, 921 bp, Homo sapiens
  misc_feature (823)..(823): n is a, c, g, or t
  misc_feature (825)..(825): n is a, c, g, or t
  misc_feature (827)..(827): n is a, c, g, or t
gtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggaatttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaacgngnanaacacaccacaacagctcctacaatactacactaaacacaaaaaggggcggcgatacaacaccagggcgggcactacagctccccctgtttacg

SEQ ID NO: 416248 - DNA, 1201 bp, Homo sapiens
gtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggaatttatgctctgccgctgggaagagaaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaaaaaaaaaaaaaaaaaaaaaacacaaccacaaaaccagacaacgacaacaacggacaacacagcgaaaacacaacacacataaaaaaaaaggaggggggggcgcgcaatatactaatcccccgggggggggagaccacgtatgatagccgacccaccgatcgtgtgagtaaacaaagggggcggcccactaaaggggatggcgtaattaaaacagaagcgagggcgagggccgcctaatacaaacaccgacggtcggagtgaagaccaccggacgcgtggagggtacctgtggaaggagaacgcacccaacttcgtgggggtggagacaactgagggggcaaaacccaccagagaaagatgcgccgcgcgggaagaaattaa

SEQ ID NO: 416249 - DNA, 776 bp, Homo sapiens
gtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaataaagatccgaggcggtgtttagaggaaggcaaactggtcaacaagtgtgctttggacttctttaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaa

SEQ ID NO: 416250 - DNA, 656 bp, Homo sapiens
gtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggcagataaaacgtcactgtgcagagccttttacagaatattggacttgcattgattatactggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaa

SEQ ID NO: 416251 - DNA, 760 bp, Homo sapiens
gtgttgccggatgcgcatgcgcaggcgccgtgtggcactcggcggtcgaaaggggagttcaaggagacgggggcgacgcggctgagggcttctcgtcggggtcggggctgcagccgtcatgccggggatagtggagctgcccactctagaggagctgaaagtagatgaggtgaaaattagttctgctgtgcttaaagctgcggcccatcactatggagctcaatgtgataagcccaacaaggaatttatgctctgccgctgggaagagaaagatccgaggcggtgtttagaggaaggcaaactggtcaacaagtgtgctttggacttctttagtggccagcagttatttcgtcactgtcgcaaacagcaggcaaagtttgacgagtgtgtgctggacaaactgggctgggtgcggcctgacctgggagaactgtcaaaggtcaccaaagtgaaaacagatcgacctttaccggagaatccctatcactcaagaccaagaccggatcccagccctgagatcgagggagatctgcagcctgccacacatggcagccgcttttatttctggaccaagtaaagatgggtccgtggcccacactcggtcatgtgctcagacaacgactgatgaaaacgcccatgcggtttgcatcgactgatagtgtgttctttccgggatcacaaacattaacaaaaaagttaacttatgtgacttggcagttattctataccatttcctgtccattaaaatttttaaaggaaa

SEQ ID NO: 416252 - DNA, 1564 bp, Homo sapiens
cacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 416253 - DNA, 5156 bp, Homo sapiens
  misc_feature (1081)..(1081): n is a, c, g, or t
  misc_feature (2526)..(2526): n is a, c, g, or t
cactgcagggtgctaagcagcctccacccagtccccagtggtgacacccaaaactgtgtccagacattgacaggtgtctccaggagggagactcgcctccatctgagaagcagaaccagcctgacagtccacctcccggctgaaaagtgcttgcatgtgcgatttgccttccgcctgggagtctgggggcactgggatgccatccttgccccaccctggctttcagagctctctcctctcctcctcgtgtgcccatgagtccggctcacaggaacgtgggtctcacatcaggtcctgagggagcaggtgtgtttctgggcctgaggctgctccttggtagtgagggtgtccccacgagccgtgtctgtggcgcctgcagctgcctgcatgtccatctgtgtccacatctgcctttgagcctcatcttcctggccccacggttttctcatgctgtgacccaaaagccaagcattccagggtgttctgctgaaattgagttgtgagcgtgtctctctcctcgctccagtctgaaggagaagcgtggtcggtagatagacgtctcagaccttcgtgttttcttcacgtctgtctgttggcaggtccttacactattgtggttgctttagcaacttagctgttgtcgacttaatgtgtttcatgacgttctgcagcaaggaagaaggtccgagtttccactctcaatcaggcaccttcgttcccctcccccctcacttgacttcctgtggggtgtgtggtgtctgcacttatagatgagaatgctgaggcctcaggagggcaagggactcgcccacggtcacggaaccctaagtcaggggtggagaaggaccccctgacgccagcccacctcccctgcccctcagcaggcctggctccagcacagagaagagccattgttgctgctctgggggccctaggagcctgggatgtatcctgcctttgtttctagagcctttgtttgttgtatttcctctgtctccagacatcgcaggccggtgggacccggcgcctgtgcacgctcacgtagcggggcctgttcgggtccctcgtgggtcccttcagntcgagctctgtccttgcctcagcggcccgtcacccatagggtggcagagatgggccgggggagggagtgggcagcagtgcggaccgagtcctggcgcatggggtttccctggtgctggagccgggcgtttcgggggtgtgggcggggctggggtcatatcccctgcatgccccgcatgccatggctgtactcacatggcaagaggtggtgatcgccagctcagggaaggtgggggttccttcatcctgtggagagggggctgaattggggtcccctgagctgtagggtgcagtgcctgacaggccgtggggagggccgaggggatggggactgacaggccccgggcccatgccgccccctggcacgggtggatgccccgcctcccgggggtgcccagctggactgtggcacccccaaaggaccccacatgtcactgttcccccgcagggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtgagggcgaccctgggggcagctcagcctgggcacacccaagaggggaccaggcggggggccggggggcgggcttccctgggaggaaggtgggcggccctgcaggaggggagccacagtggatgcacagggccagagagccggacaggcgagcttgggtgtgcaggtgccgcctccacatggctgaggtgtggccaggcggtcctcccacaccctggcctgtggagccaggntccctgggaacccctggcctgaggatgggaaggggctgagcttgtcacaggggtgtggatgccacccggcgggagggagtgggtggtggtctgggggtctgtgcacgtgtggctgggagcccatcggccgaggcagcacttggggccaagtgaggcgaggctgctgcatccaggtccggaggactggcccatgaggccctgtggctgcggagcttggccatcctggggcagggcctacagggtaaggtgcagacccgcagcacacatccgaggtctgggccagcctcgattccagatccagccctcctagtcatccacgtccccagccctgcgcttgcctgggcccttcaccggtgtttgagcaccgcccgggccagtgctgctttggacgaggagacccgggtgggcctctggtggcttttcctgctcaccatccactgggcctgtctcgtcctggccctgcccagcccactggtctgacctgctcccgcagggaccaggcacagctctgagaagtcagaggccctagggaggtggggtcgtcgttgccttggtgatatgcaggcagtccctgcagtgggcctgggagctggtcccctggcaccaccctggctctgggggcctcccagcagtgtgggacgctgacaccaatcaccacttcatgcgacttcctcggcccctcctgtctctactgcctgggccactggcagagtcacacctgccatggccagctctgagctctgtctgctcggccatctgtcctgctgccactttgtcctgcaggaacctaggcccagagctgtgagggggaggccagagcgtgcccagggcctccaccggggatgtgtcctgttcgtttgagtggtgacatccaggtggcagctcggggctcctgcctgtagcaggtggcagggctgggctggctcagcacactactgaccatggctgccagggagcaggccagggaggccgaggcagagctggagccacaggcaccagccaggcagcatcctttggggcatgggtgagtggcgagctgtggagtgctgccaggaggctgggattccaggccagggacggggacagccctgctggtggagatgccaggcagaggggacgcacacctgcccatgctcctgccttgcaagagggcgtctgcctgggatcagagcctagagcatgtgggaggagagttgtggggtcccggcatgggcagggtggcaggtgggtcccgtgtgcttgggactgggcacgaggaggccttgtaactggtgctggatcagctgggtcaggggccgcacaccaatgacctgggggtgagggtgcccctgggtgggagctggtggtgctgaggtggccgaggacttgtccactcccaagggaaggtgctggtgggagggggtgccacctccgcagccaccaccctcgatgctgacctgggttgcactggcatctcattgggcgtggggactccgagagtccaaaattgggtggagacatttggggacacagctgcctgaattcctcatggccaagggggtgggcaagggctgcagggaggaatagtgtccgctgtcctggccagtgcaccaggaacggttttctaaccctggcaggaaggtgtgaagcattcaggatgtgggggccacacagttcccagtgtgcacctaggggtgaccaggaggaggagaggcgccagggcctcccttacccccgccccaggggcactccgtaggcaggatccctgcagatcctagctaggaaacgccagtgaacggcagcgcagggaacggggcggggccgctggcttcgcccaccgccacggtgttgggggctgggggtggccctcgggactggtgtggagcctgagcctgacccactgacttggctgagtggggagactggagggtcgcatccggagctgggcccggggacgcccgctggtgggaagggtgcgcgagcgtcggaggccgcggctgaccctgctccggcgccgccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 416254 - DNA, 3797 bp, Homo sapiens
  misc_feature (1167)..(1167): n is a, c, g, or t
cacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtgagggcgaccctgggggcagctcagcctgggcacacccaagaggggaccaggcggggggccggggggcgggcttccctgggaggaaggtgggcggccctgcaggaggggagccacagtggatgcacagggccagagagccggacaggcgagcttgggtgtgcaggtgccgcctccacatggctgaggtgtggccaggcggtcctcccacaccctggcctgtggagccaggntccctgggaacccctggcctgaggatgggaaggggctgagcttgtcacaggggtgtggatgccacccggcgggagggagtgggtggtggtctgggggtctgtgcacgtgtggctgggagcccatcggccgaggcagcacttggggccaagtgaggcgaggctgctgcatccaggtccggaggactggcccatgaggccctgtggctgcggagcttggccatcctggggcagggcctacagggtaaggtgcagacccgcagcacacatccgaggtctgggccagcctcgattccagatccagccctcctagtcatccacgtccccagccctgcgcttgcctgggcccttcaccggtgtttgagcaccgcccgggccagtgctgctttggacgaggagacccgggtgggcctctggtggcttttcctgctcaccatccactgggcctgtctcgtcctggccctgcccagcccactggtctgacctgctcccgcagggaccaggcacagctctgagaagtcagaggccctagggaggtggggtcgtcgttgccttggtgatatgcaggcagtccctgcagtgggcctgggagctggtcccctggcaccaccctggctctgggggcctcccagcagtgtgggacgctgacaccaatcaccacttcatgcgacttcctcggcccctcctgtctctactgcctgggccactggcagagtcacacctgccatggccagctctgagctctgtctgctcggccatctgtcctgctgccactttgtcctgcaggaacctaggcccagagctgtgagggggaggccagagcgtgcccagggcctccaccggggatgtgtcctgttcgtttgagtggtgacatccaggtggcagctcggggctcctgcctgtagcaggtggcagggctgggctggctcagcacactactgaccatggctgccagggagcaggccagggaggccgaggcagagctggagccacaggcaccagccaggcagcatcctttggggcatgggtgagtggcgagctgtggagtgctgccaggaggctgggattccaggccagggacggggacagccctgctggtggagatgccaggcagaggggacgcacacctgcccatgctcctgccttgcaagagggcgtctgcctgggatcagagcctagagcatgtgggaggagagttgtggggtcccggcatgggcagggtggcaggtgggtcccgtgtgcttgggactgggcacgaggaggccttgtaactggtgctggatcagctgggtcaggggccgcacaccaatgacctgggggtgagggtgcccctgggtgggagctggtggtgctgaggtggccgaggacttgtccactcccaagggaaggtgctggtgggagggggtgccacctccgcagccaccaccctcgatgctgacctgggttgcactggcatctcattgggcgtggggactccgagagtccaaaattgggtggagacatttggggacacagctgcctgaattcctcatggccaagggggtgggcaagggctgcagggaggaatagtgtccgctgtcctggccagtgcaccaggaacggttttctaaccctggcaggaaggtgtgaagcattcaggatgtgggggccacacagttcccagtgtgcacctaggggtgaccaggaggaggagaggcgccagggcctcccttacccccgccccaggggcactccgtaggcaggatccctgcagatcctagctaggaaacgccagtgaacggcagcgcagggaacggggcggggccgctggcttcgcccaccgccacggtgttgggggctgggggtggccctcgggactggtgtggagcctgagcctgacccactgacttggctgagtggggagactggagggtcgcatccggagctgggcccggggacgcccgctggtgggaagggtgcgcgagcgtcggaggccgcggctgaccctgctccggcgccgccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 416255 - DNA, 1498 bp, Homo sapiens
cacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 416256 - DNA, 1646 bp, Homo sapiens
cacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaagtgagcggcccgggcggggacgggggcggggcggggcccgggccgggcgcgaagtctcaccggctccacgaccctcccgcagcatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 416257 - DNA, 1532 bp, Homo sapiens
cacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcatgcgcgtcgccttccccgacaccaagaagacctactgcttcgacgccttccctaacatcgagaaggtgtccaagatcacgtctcccgtgctcatcatccacggcacggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccggccggaccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 416258 - DNA, 1518 bp, Homo sapiens
cacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatgccgacatcgacgccgcctggcaggccctgcgcaccaggtacggcatcagcccggacagcatcatcctgtacgggcagagcatcggcacggtgcccaccgtggacctggcctcgcgctacgagtgtgccgcggtggtgctgcactcgccgctcacctcgggcgctctcccccctgcccgcgactcggagcaccccccacccctcccctgccgggccaggccgggcggcgttgttggcgggggcccccggtggaggcccggcctgggcggcgccccgccatgactgggctgccgctgtgggtggagggcgccgggcacaacgacatcgagctctacagccagtacctggagcgcctgcgtcgcttcatctcccaggagctgcccagccagcgcgcctagcggcggccccaaccggccggacctcagcaataaggcggcccccggacctcaccccgcgccggcccccacccaggggctgcatgtggaccccccgggcggcccaggggaccccgccccgacccaggggctgtggacgatgtacaggcaacagagctacgcactcctttccttttggaagcaagaagaaaatacgtgaaaacggaaattaaagatttaaaatttta

SEQ ID NO: 416259 - DNA, 1015 bp, Homo sapiens
cacttccggggcggtggtgagaacgaggctcacttccgtccgtggggggagctgcggcggtggcggtgcaggaggccgggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtacacggtcctcttctcgcacggcaatgccgtggacctgggccagatgagcagcttctacattggcctgggctcccgcctccactgcaacatcttctcctacgactactccggctacggtgccagctcgggcaggccttccgagaggaacctctatggaccccgccccgacccaggggctgtggacgatgtacaggcaacagagctacgcactcctttccttttggaagcaagaagaaaatacgtgaaaacggaaattaaagatttaaaatttta

SEQ ID NO: 416260 - DNA, 1879 bp, Homo sapiens
  misc_feature (1081)..(1081): n is a, c, g, or t
cactgcagggtgctaagcagcctccacccagtccccagtggtgacacccaaaactgtgtccagacattgacaggtgtctccaggagggagactcgcctccatctgagaagcagaaccagcctgacagtccacctcccggctgaaaagtgcttgcatgtgcgatttgccttccgcctgggagtctgggggcactgggatgccatccttgccccaccctggctttcagagctctctcctctcctcctcgtgtgcccatgagtccggctcacaggaacgtgggtctcacatcaggtcctgagggagcaggtgtgtttctgggcctgaggctgctccttggtagtgagggtgtccccacgagccgtgtctgtggcgcctgcagctgcctgcatgtccatctgtgtccacatctgcctttgagcctcatcttcctggccccacggttttctcatgctgtgacccaaaagccaagcattccagggtgttctgctgaaattgagttgtgagcgtgtctctctcctcgctccagtctgaaggagaagcgtggtcggtagatagacgtctcagaccttcgtgttttcttcacgtctgtctgttggcaggtccttacactattgtggttgctttagcaacttagctgttgtcgacttaatgtgtttcatgacgttctgcagcaaggaagaaggtccgagtttccactctcaatcaggcaccttcgttcccctcccccctcacttgacttcctgtggggtgtgtggtgtctgcacttatagatgagaatgctgaggcctcaggagggcaagggactcgcccacggtcacggaaccctaagtcaggggtggagaaggaccccctgacgccagcccacctcccctgcccctcagcaggcctggctccagcacagagaagagccattgttgctgctctgggggccctaggagcctgggatgtatcctgcctttgtttctagagcctttgtttgttgtatttcctctgtctccagacatcgcaggccggtgggacccggcgcctgtgcacgctcacgtagcggggcctgttcgggtccctcgtgggtcccttcagntcgagctctgtccttgcctcagcggcccgtcacccatagggtggcagagatgggccgggggagggagtgggcagcagtgcggaccgagtcctggcgcatggggtttccctggtgctggagccgggcgtttcgggggtgtgggcggggctggggtcatatcccctgcatgccccgcatgccatggctgtactcacatggcaagaggtggtgatcgccagctcagggaaggtgggggttccttcatcctgtggagagggggctgaattggggtcccctgagctgtagggtgcagtgcctgacaggccgtggggagggccgaggggatggggactgacaggccccgggcccatgccgccccctggcacgggtggatgccccgcctcccgggggtgcccagctggactgtggcacccccaaaggaccccacatgtcactgttcccccgcagggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgggaccccgccccgacccaggggctgtggacgatgtacaggcaacagagctacgcactcctttccttttggaagcaagaagaaaatacgtgaaaacggaaattaaagatttaaaatttta

SEQ ID NO: 416261 - DNA, 1631 bp, Homo sapiens
acattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaa

SEQ ID NO: 416262 - DNA, 1234 bp, Homo sapiens
aggagtttggctcaaggctggggctagtttctttcagtattttagacaacaacctaaacacctctatcagtgcctgggaatgttcaaggccctggcttggggtcaagcctgcaggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatacttccatttcttcaatatcagtttatgtgggcatgaggggaagaagatggctctctgtaccaacaatataacagactttacagtaaaagaaatagtggcagggtcagatgattacacaaatttggtaggggcatttgtatgccagtcaacaattattccttctgaaagtaagggtttccgagcagccttatcatcacaatccatcattctggcagatacattcataggagtcacagttgaaaccacattgaaaaatattaatataaaagaagatatgttcccagttccaacaagccaaataccagatgtgcatttcttttataagtcttctacagcaacaacatcttgtattaatggccgatcaactgctgtgaaaatgaggtgtaa

SEQ ID NO: 416263 - DNA, 1527 bp, Homo sapiens
acattcagcaacaaaccaggttcattcaactgccaggtgtgtcccagaaacacctattctgagaaaggagccaaagaatgtataaggtgtaaagacgactctcaattttcagaggaaggatccagtgagtgtacagagcgccctccctgtaccacaaaagactatttccagatccatactccatgtgatgaagaaggaaagacacagataatgtacaagtggatagagcccaaaatctgccgggaggatctcacagatgctattagattgcccccttctggagagaagaaggattgtccgccttgcaaccctggattttataacaatggatcatcttcttgccatccctgtcctcctggaacattttcagatggaaccaaagaatgtagaccatgtccagcaggaacggagcctgcacttggctttgaatataaatggtggaatgtccttcctggcaacatgaaaacttcctgcttcaatgttgggaattcaaagtgcgatggaatgaatggttgggaggtggctggagatcatatccagagtggggctggaggttctgacaatgattacctgatcttaaacttgcatatcccaggatttaaaccaccaacatctatgactggagccacgggttctgaactaggaagaataacatttgtctttgagaccctctgttcagctgactgtgttttgtacttcatggtggatattaatagaaaaagtacaaatgtggtagaatcgtggggtggaaccaaagaaaaacaagcttacacccatatcatcttcaagaatgcaacttttacatttacatgggcattccagagaactaatcagggtcaagataatagacggttcatcaatgacatggtgaagatttattctatcacagccactaatgcagttgatggggtggcgtcctcatgccgtgcctgtgccctcggttctgaacagtcgggttcatcgtgtgtcccctgccctccaggccactacattgagaaagaaaccaaccagtgcaaggaatgtccacctgacacctacctgtccatacatcaggtctatggcaaagaggcttgtattccatgcgggcctgggagtaaaaacaatcaggaccattcggtttgctatagtgactgctttttctaccatgaaaaagaaaatcagagtttgcactatgactttagcaacctcagcagtgtgggctcattaatgaatggccccagcttcacctccaaaggaacaaaatattgacacatatttaccaaccagtgccacgcctgacccagaaccttctcacttgaacaccaggaatggacttaaaggctttatggcgttcaggcttagactgctaaggtacgagttcaacctgattcatcagattaagctaaatacatacagccttgggtgtaggtggtatttacattaggactcctccctctcctatagaaactgtttctcaagcccaacttagggagagagcagcaggcaggaacaggacgatcacaaccttcatttctcattagtttctac

SEQ ID NO: 416264 - DNA, 2162 bp, Homo sapiens
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatactttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaa

SEQ ID NO: 416265 - DNA, 2425 bp, Homo sapiens
  misc_feature (2255)..(2255): n is a, c, g, or t
  misc_feature (2260)..(2260): n is a, c, g, or t
  misc_feature (2263)..(2263): n is a, c, g, or t
  misc_feature (2270)..(2271): n is a, c, g, or t
  misc_feature (2274)..(2274): n is a, c, g, or t
  misc_feature (2276)..(2276): n is a, c, g, or t
  misc_feature (2280)..(2280): n is a, c, g, or t
  misc_feature (2288)..(2288): n is a, c, g, or t
  misc_feature (2292)..(2292): n is a, c, g, or t
  misc_feature (2300)..(2300): n is a, c, g, or t
  misc_feature (2305)..(2305): n is a, c, g, or t
  misc_feature (2310)..(2310): n is a, c, g, or t
  misc_feature (2320)..(2320): n is a, c, g, or t
  misc_feature (2332)..(2332): n is a, c, g, or t
  misc_feature (2335)..(2335): n is a, c, g, or t
  misc_feature (2342)..(2342): n is a, c, g, or t
  misc_feature (2345)..(2346): n is a, c, g, or t
  misc_feature (2350)..(2350): n is a, c, g, or t
  misc_feature (2352)..(2352): n is a, c, g, or t
  misc_feature (2360)..(2360): n is a, c, g, or t
  misc_feature (2362)..(2362): n is a, c, g, or t
  misc_feature (2371)..(2372): n is a, c, g, or t
  misc_feature (2377)..(2377): n is a, c, g, or t
  misc_feature (2389)..(2389): n is a, c, g, or t
  misc_feature (2396)..(2396): n is a, c, g, or t
  misc_feature (2403)..(2403): n is a, c, g, or t
  misc_feature (2421)..(2421): n is a, c, g, or t
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctgggcaacaagagcaaaaaactctgtctcaaataataataatgataatagtaatatttctaattactagcctagtatagacactactggggaccaggctactcctgttcgttgcctgtagatgtttattattttagctggatggtataagtttgatgatggactgttcatatgttcttgcaaatgcagtgaactatattacacaccattaattataagtcttccacactcagattctgtgaaagtccccctaatttgttgatgacataaagctccacctctacaatcatatgccttttttaaggagtgtcatgaatccagatactgagatcaggaacttacataaggccaactaaaaaaaccctttacaatgtattttacatatattatagtttgtaagtataaacattcaactactgttaatggacttctaagagaagtcgagtcatttctgtgtgttggaacctcctgtgatcatcatccagaggaagtttcatatacgctggaaatccagtttcataaaatgttacctaaaatgtaatgacctcaaatggagtgtactcagtaactctagaataggaaggatcttctgatctttgcaaagattgcagaggcgtctctgatgagataattgagttccttcctctgattttctgaattgaacctgcagcaattcatctttttaatcaagctgctaaagtacaatggatctctgcagtgatttaggatgtccagttctaggaagcattgttctgggctttcagaatgtaggaggagatctttgtactatttcagtctttttgataaacaagtcataaagaagaaaccagttgtctgagattgccataaactgtaaactctttgacagtaacataaagagatggattaaattggaatacaaccaaatttatctggaggttctgaacaaaggctggtcactgaagtaatcatagaattgacagccaagcactcctttccatcagttaagtaaagaacgaaataaactgtttacatgattttatcccccattctgaatggaagacaaaagcttcaggaacccttgatggcagataaaatgtcctgtggagtcttcttggtaatcattagagcacgttgttttatcatctgagacagtaagaaccgaaacaatttaacaatgtcttcaaaggctttgctagattagacagtacgaaaaataaacatcaagaatgtggaaactatcatgtacaagaaagaccatgcaatgttgactcttttttttattttttcctctctctcttttgagacagagtcttgctngagtncantggcgcnntcncngctnactgcaanctcngcctcccnggttnaagcnattctcctgnctagcctcctgngtngctgggnttnnaggngnccgccacnangcctggctnnttttngtatttttagtngagacgnggtttcnccatgttggccaggctgntctc

SEQ ID NO: 416266 - DNA, 902 bp, Homo sapiens
caaatttaaattttattagtcgattagctgtactttttaaaatgttttattctgaaaatgaattttccacaataatgcaattcaaagtgaactcatttatctggcttttctacaaaggacaattgaaacacttaaggcgaaattcacttattcatctccatttaagaatggaaaaaaagtaacagacttcagatactggttaaggttaacaaaatatgggaaggctcctttttcttttctttctttttttttggtagtctcgtgtaaaagctttacattactatggatattttatagtaagacacttttgtttctgactttctttataaacccatttttaaatttaaaggcacacaataaagctttatgcatttattaaaatatacacattttgttaaatttagaattttcccttagtatcttgataaatcaatatattgtcaacaccacacatttgaaaataaaacacatttcataatacatctgcatattatttctttcttcatgatacactacattgtacagcacaccaatgggaattaaaaaccacaaaacgaacaaactttaacaaatacagcaatttcataccaaaaaaagatagcagagaacaacactaggaattaccatctgtaaatgcaagttgtacttctcaaggacgaaacgaaaaagaaacaagttagtaaaatttacaagctgtatttataactttggatattaattaaacagtaacgtttcttttccacagtgagaaaagctagaatgtggagtcctgtcatcagatgatgtgactacatggaatgaggactatagctgctctcttaaaaacctgcagccccctctctcagcccagacagttgaggtatttatgcaccatcataacattaacagcatctttgctttgg

SEQ ID NO: 416267 - DNA, 921 bp, Homo sapiens
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggactcagggtgacaagaagtggattctaaagtgctgagggctcagtgggccagcccaggcctggagtctgaatgaagaggcatcagtgtgccggaacttcatgactgggttcagtgccagacctgcagacgttgaaagtgaatgtcatcatgaagcccacatggctggatggtgagaaaagctagaatgtggagtcctgtcatcagatgatgtgactacatggaatgaggactatagctgctctcttaaaaacctgcagccccctctctcagcccagacagttgaggtatttatgcaccatcataacattaacagcatctttgctttgg

SEQ ID NO: 416268 - DNA, 2731 bp, Homo sapiens
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatactttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaaaaaaaaaaaaaaaaaaaaaacaaaaaaaacaaacaacaaaacaaaaacaaagacagagcagacccacaatcaagaaattaggagacaacagcagacacagcacaaacacaacatagcacgaggcggagtcacccacaaagtggcgccactacacgccgagcacaacacccaccgaggagcggagcgtacgggatcacgaccatgtcggcaggcaaagagagagcggagatcggcagacgggaacaacccaataagtatgcggtagtcggacgacttaattaatcggagagagtaagacaagagaagcgaacatagagaacaagcagaagacggatcaacacgagagaatagcaatcggtcggacacaacgagagcaaactcaattcgctaaagaccataaaaattatagagacgcgacaccagtcctgagcaccaccgtgaggagtcagaaaacagccacgactagcacacacgcgacgacggaccgcacacaccaccaccagcagacgagatagcacgatacacacaacgagatacatcacaactgaaataagaaagaccatcaaccc

SEQ ID NO: 416269 - DNA, 2321 bp, Homo sapiens
agcagcgctgctgtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatactttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaaaaaactggccttcaatcttctgttgtatccagaggtatcattattgatttaaaaaaatctcattaatctctactggtaatttatagggaatctgatcagtgattcaagaacaagtaattctgcattgccttgaataattaaaaagttatattttattca

SEQ ID NO: 416270 - DNA, 544 bp, Homo sapiens
gtaagacagctttctcagtggtaccctacctatgagggagcctgatgaatctcagatcttgtggttgctgccttctcaagttcaagagaaatgtgaaaggaagccaagtgaagccagtgggggatggactcccacaatctgtatccctttgtattttatgggcagtttacacagagggctaagtaatgtctctgggagtcactgaccatgaagataagtttaaaaagagaaagaggattttgaaggtaggaaatacctaagggaaagacctgaaagatggaagccttctcagtcttcacagtggaatcctttttgaacacctatgcccaggtcccacagcagatcaattgaatcagaattttctgggcatcaggccaggcaaagatattttttgaaagcttcccaggtgatgcttatgtgcaggcaagactgagcagctcagttaataaagaaggaggccgaggtgggcggatcacctgaggttggaagttcaagaccagcctggccaacatggtgaaaccccatctctactaaaaatacaaaa

SEQ ID NO: 416271 - DNA, 505 bp, Homo sapiens
atggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggtaaggacccgagcttggcggcggctcccaaatccttatcctctgggtagagagcgggatattagacggcgtcacagagacattttgggggcttgaagacctttgggtacgtttttgacatccctagtcccaccttgttgtaaaagaattaggcagccccgaacttaacttctctaggccgcagtattcttatctggaatttgagataatagtggcaatgtggccggtggtaacactggccgggtccctttgagaatgaacaaaccggaacacctaata

SEQ ID NO: 416272 - DNA, 1853 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416273 - DNA, 1968 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggtgcagccaacccccaggaggatgattgctaagcaaagccggagcctcccgcccactccttgctggagccagctgcagaaccgggggccccggggctgctgggggggcaccagggttagctcagccacttgcctggcgcctcacccgcataaccatcccttctctcactttctctttgcagcccagtcatctcaggatcccgctaaccttttcttcatccacctcttcttcctcctggatctcatctgcaccctgcctcttccctctctgcccctgtccgggttttctctctgcctgctcacgcctccatcccgggtctgccctggtcccagcctcccgtgccctccacccaggccccctggccctgcatcccagagcgtcctgcctgccgcctcctgcgccccttctggtacctcctgcctcccagcctggggaggaggggcgcagctgcacctcctctgtgcccactaaccctgccgggcacctctgagactgggccctggctgcaggccctgccccccctcctctcctcccggcctcctcctcacgtttcctccttgcaggttcccgtccgcaccctctcagacctgaggctgagcttgcagtgagggcttctcctcggcccctcgcccgcccccagagctgccatccctggtttgtagcttggcggtgctggagggaggggtggagcgaggagggtgctcatctcttgatccttggacttgagccgagctttcggctgattatctccacccaccaaagtttctcatccgaccttgccctgcatcaccccctccttaccggccccacctccgcccctcccatcctcctgcccttcccctcttttttttctagctgttacaagccagaggcacccggatgtgaggccccagatcacctccagggacttggggttcccatctgaaatcctttatttttgtaccatgggcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416274 - DNA, 355 bp, Homo sapiens
gtgtcactgccttgtggcatcccctatttctgtggggatggggaggacaggccacttttggatacccttggcccatgaagtgtcagccagagtggcttaaggattgcagagtggcagaaaaagccctggccatgtgcccacaagccccctatcccactcttttctgcctgctctgtgaccttgggcaagtcactgtccctctctgggccacaattgcctctaaaattgggagcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416275 - DNA, 2469 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggtgcagccaacccccaggaggatgattgctaagcaaagccggagcctcccgcccactccttgctggagccagctgcagaaccgggggccccggggctgctgggggggcaccagggttagctcagccacttgcctggcgcctcacccgcataaccatcccttctctcactttctctttgcagcccagtcatctcaggatcccgctaaccttttctccctcccaccactgcctcctcctccgcttcccgctggaggtcctgcctcatcttcatccacctcttcttcctcctggatctcatctgcaccctgcctcttccctctctgcccctgtccgggttttctctctgcctgctcacgcctccatcccgggtctgccctggtcccagcctcccgtgccctccacccaggccccctggccctgcatcccagagcgtcctgcctgccgcctcctgcgccccttctggtacctcctgcctcccagcctggggaggaggggcgcagctgcacctcctctgtgcccactaaccctgccgggcacctctgagactgggccctggctgcaggccctgccccccctcctctcctcccggcctcctcctcacgtttcctccttgcaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416276 - DNA, 2288 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaagcccagtcatctcaggatcccgctaaccttttctccctcccaccactgcctcctcctccgcttcccgctggaggtcctgcctcatcttcatccacctcttcttcctcctggatctcatctgcaccctgcctcttccctctctgcccctgtccgggttttctctctgcctgctcacgcctccatcccgggtctgccctggtcccagcctcccgtgccctccacccaggccccctggccctgcatcccagagcgtcctgcctgccgcctcctgcgccccttctggtacctcctgcctcccagcctggggaggaggggcgcagctgcacctcctctgtgcccactaaccctgccgggcacctctgagactgggccctggctgcaggccctgccccccctcctctcctcccggcctcctcctcacgtttcctccttgcaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416277 - DNA, 2054 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggttcccgtccgcaccctctcagacctgaggctgagcttgcagtgagggcttctcctcggcccctcgcccgcccccagagctgccatccctggtttgtagcttggcggtgctggagggaggggtggagcgaggagggtgctcatctcttgatccttggacttgagccgagctttcggctgattatctccacccaccaaagtttctcatccgaccttgccctgcatcaccccctccttaccggccccacctccgcccctcccatcctcctgcccttcccctcttttttttctagctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416278 - DNA, 1999 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagcccatataaaaaaaaaaaataaaaaaaaaattttataaatattttataaatatatttaatttttgtgtggggggtgtgctttattgttcttaatgttagtaatattatattaatattatttcttgggggggggccccggccccaattgcc

SEQ ID NO: 416279 - DNA, 1989 bp, Homo sapiens
atactcaggactaggggttccatctgaaatcctttatatatggtaccatggggtgggccccgagagcctgagaacggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggtgcagccaacccccaggaggatgattgctaagcaaagccggagcctcccgcccactccttgctggagccagctgcagaaccgggggccccggggctgctgggggggcaccagggttagctcagccacttgcctggcgcctcacccgcataaccatcccttctctcactttctctttgcagcccagtcatctcaggatcccgctaaccttttctccctcccaccactgcctcctcctccgcttcccgctggaggtcctgcctcatcttcatccacctcttcttcctcctggatctcatctgcaccctgcctcttccctctctgcccctgtccgggttttctctctgcctgctcacgcctccatcccgggtctgccctggtcccagcctcccgtgccctccacccaggccccctggccctgcatcccagagcgtcctgcctgccgcctcctgcgccccttctggtacctcctgcctcccagcctggggaggaggggcgcagctgcacctcctctgtgcccactaaccctgccgggcacctctgagactgggccctggctgcaggccctgccccccctcctctcctcccggcctcctcctcacgtttcctccttgcaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416280 - DNA, 1626 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccggctgcccctgtccgggttttctctctgcctgctcacgcctccatcccgggtctgccctggtcccagcctcccgtgccctccacccaggccccctggccctgcatcccagagcgtcctgcctgccgcctcctgcgccccttctggtacctcctgcctcccagcctggggaggaggggcgcagctgcacctcctctgtgcccactaaccctgccgggcacctctgagactgggccctggctgcaggccctgccccccctcctctcctcccggcctcctcctcacgtttcctccttgcaggttcccgtccgcaccctctcagacctgaggctgagcttgcagtgagggcttctcctcggcccctcgcccgcccccagagctgccatccctgctgttacaagccagaggcacccggatgtgaggccccagatcacctccagggacttggggttcccatctgaaatcctttatttttgtaccatggggtgggccccgggcctgagaaggaagaagcaccctctccccggcctcctctgtctgcacccgtggggctgtgacttactcctgcctccaggggcggggcggggcccccctgggacctcttaaggcccaaggtgggccccaggacctctgggcagagtggactgctcatggcagatgtgtggcaatgtctggctgtgtctctccggcacctgcgtcccctctcccgggctcccctgctgcatggtggatgtgctccttcctggcccggtcacattgcctccttgagccttagtccagggggtcactcctcccaccccacctacctcacagggttgttgtgagggtgcacagaggagcaaagtccctgaaggccctcaggcagtatataggggccgcccaccttcagctgccctgggatgggaaggacccagcccgacccctgggcataacactgtgtttgcaaatggagattcaggtattggggatgcaggttgtggggagctggcctggcagagtaggggtagttggcttggccttctctttggtgatcccacccccagccatttgcattgctggcccagcgcctggcctggggggcggggagaggcagcagaaggggctgggcaggggcggtggaggactcaggaactgcccggggagagtgggtatggcggctgagccaggggccctcctgtgtttgacttcccgggatgggtccttgcttctcagctgtgtccgaccccaccatgtaataaaacccaaaggaacagccca

SEQ ID NO: 416281 - DNA, 994 bp, Homo sapiens
agactgcgggcctgcggggaagggcgaagcggggcgggaccgggggcgggagcagcgcggggcgggaccctacccgcggcccacgcggagccaggaggcgcggactacagctcccggcctgccccgcgtgcggtccccgcccgcccccagcgcccgggaggaggatgcagacgccgcggcggcgatgaggatggaggccggggaggcagcgccgccggcgggggcgggcggccgcgccgcaggcggctggggcaagtgggtgcggctcaacgtggggggcacggtgttcctgaccacccggcagacgctgtgccgcgagcagaagtccttcctcagccgcctgtgccagggggaagagctgcagtcggaccgggatgagaccggggcctacctcattgaccgtgaccccacctacttcgggcccatcctgaacttcctccggcatggcaagctggtgctggacaaggacatggctgaggagggggtcctggaggaagccgagttctacaacatcggcccgctgatccgcatcatcaaagaccggatggaagagaaggactacacggtcacccaggtcccacccaagcatgtgtaccgcgtgctgcagtgccaggaggaggagctcacgcaaatggtctccaccatgtctgatggctggcgcttcgagcagctggtgaacatcggctcctcctacaactacggcagcgaggaccaggcagagttcctgtgtgtggtgtccaaggagctccacagcaccccaaacgggctgagctcagagtccagccgcaaaaccaagagcacggaggagcagctggaggagcagcagcagcaggaggaggaggtggaggaggtggaggtggaacaggtgcaggtggaggcagatgcacaggagaaaggtgcagccaacccccaggaggtactcgaggtgtctaagcttatccggagcgtacacgcgcactcactggtctaaagcctgtctcctggatatcaagac

SEQ ID NO: 416282 - DNA, 261 bp, Homo sapiens
ctccccccaaccacctcttctttctctccctctcttcttctttgggtatgttgcgggggtggtggcagcaggtgctcatgcccctcctggggtgcctggtgctcccacaggtgccctctatgtgacccttctgcccacaggtcccacccaagcatgtgtaccgcgtgctgcagtgccaggaggaggagctcacgcaaatggtctccaccatgtctgatggctggcgcttcgagcaggtgcgctggggacaggggcgtgcca

SEQ ID NO: 416283 - DNA, 2651 bp, Homo sapiens
tgcggcggcgtggctgtgggtcccggattagcggcggcatgggacggttgagttggcaggtggcggccgcggcggctgtgggcctggctctgactctggaggcgctgccttgggtgctgcgctggctgcggtccaggcggcggcggccgcggcgcgaggcgctgttcttcccgtctcaggtgacctgtaccgaggccctgctgcgggctccgggcgcggagctggccgagctccccgagggctgcccgtgcggcctgccccacggcgagagcgcgctaagccgcctgctgcgtgccctgctggccgcccgcgccagcctggatctctgcctgttcgccttctccagcccgcagctgggccgcgccgtgcagttgctgcaccagcgtggggtgcgagtgcgggtcgtcaccgactgcgactacatggccctcaacggctcgcaaatcggtctgctgcgcaaggcagggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttaggaaagggaaatttctgttacttcgggtcagttatttcgggccagacctttttcttgctcctttgccaaaataacttcagtcacgacctgccacggggtgctttcatgagtgtggtccgtatcttggtttggaatcgaaacttctgctacagcacagaaaaggcacagtgcctcttccaggtcgatcccattcccttccctgattctagaaaagtccctcctgctttggctgatgtgggccctttcagcatctccctgagatttcatccctctctccatgtggcacgactggggttggttggggcctacagtctccttgtccctcacagtctgcccctgtcagggctcggtcctcagagtaaggaaaggaaatggaagtcaggaggaagggaagatgtgagtgtgcggtgcgggtggcaaaagcagccttcggggcaaccccgtgagcgtcattgccaccaaaggctggctgttcccttgattccttgcataattgctctttaaaaccagtatgcacgccagtgccaagctcttcagcagcctgtccttgggtagtaagtgctgtggtctgtcaggactgatggccagcagctgtttctatgttgggcttttaactttttttattttatttatttatttatttatcttttttgagatggagtctcactctgtggcccaggctggagtgcagtggcgcaacctcggctcactgcatcctctgcctcctgggttcaaacgattgtcctgcctcagcctcccgagtagctgggattacaggtgcctgccacaacacctggctgatttttttttgggtatttttagtagagacagggtttcaccatgttggttaggctggtctcaaactcctgacctcaagtgatccaccacttccgcctcccaaagtgctgggattacaggtgtgagccgccatgcccggccgggcttttaacttttaatgtcctaatgttaaggtaattttgttgtgtgtttagaagtgaccttacctttaacacctgtggagttagtgcgtgcacattgctggctcagcgtaacccatcacgggaccggaggagaggagagcggggaagaggagagcagcttcaggccgtggtgtctcccacgtctgtgttcttatttgcagctcagggtttgcattcccaggtagaacaggtgtcgtacactgtgaaatgttccaggttatttgtttataatgtgtgtgtcatatacagatagctccaatgacatctgaagttgtgacttcatcatcttgtcatatttctgtatgatgagccccagggcccatcctgaggtctgctagccatgtgcttagtctcacctccccagcccacgctggcattaccacccagagacccttcagtgctgtgtgtttttcctttttagggttacttttgactcacagtgttaggcaagccagcttggaagttaacttttaaaaaaattcaattgaagctgtaaagtataatatatagattggaagtcaccagaaattgttttagtttgtgaattcccccagtgtatgttctgaaaagaaaatgggagagcttgtaaagcatctcctaaatgcgaagccgcgtgaccctggacttctggcacatctgaataaacatgttcttattctggaaaaaaatataatatatttactttcttacattttctctaaatatacttggagggggggcccggtcccacaatggccttgtgggg

SEQ ID NO: 416284 - DNA, 2687 bp, Homo sapiens
  misc_feature (2556)..(2556): n is a, c, g, or t
tgcggcggcgtggctgtgggtcccggattagcggcggcatgggacggttgagttggcaggtggcggccgcggcggctgtgggcctggctctgactctggaggcgctgccttgggtgctgcgctggctgcggtccaggcggcggcggccgcggcgcgaggcgctgttcttcccgtctcaggtgacctgtaccgaggccctgctgcgggctccgggcgcggagctggccgagctccccgagggctgcccgtgcggcctgccccacggcgagagcgcgctaagccgcctgctgcgtgccctgctggccgcccgcgccagcctggatctctgcctgttcgccttctccagcccgcagctgggccgcgccgtgcagttgctgcaccagcgtggggtgcgagtgcgggtcgtcaccgactgcgactacatggccctcaacggctcgcaaatcggtctgctgcgcaaggcagggatccaggtccggcacgatcaagacccaggctacatgcatcacaagtttgccatcgtggacaagagggtgctcatcactggctcgctcaactggaccacgcaagccatccagaacaacagggagaatgttctcatcacggaggacgacgagtacgtgcggctttttctggaagaatttgagcgcatctgggaacagtttaaccctacaaagtatacctttttcccaccaaagaaaagtcacggaagctgtgccccacctgtctccagagctggagggagattgctttcatggcacagaacttgcggcacctccagcgaaagccaaacctaaccaagaatggggctgagccctccctgcgggctgctgtgcgttctgagggagggagacctcggcactagaaaaaaatcgttaaactaaagtctcgtctattagaatactaaattgaactaaagaaggttaggaaagggaaatttctgttacttcgggtcagttatttcgggccagacctttttcttgctcctttgccaaaataacttcagtcacgacctgccacggggtgctttcatgagtgtggtccgtatcttggtttggaatcgaaacttctgctacagcacagaaaaggcacagtgcctcttccaggtcgatcccattcccttccctgattctagaaaagtccctcctgctttggctgatgtgggccctttcagcatctccctgagatttcatccctctctccatgtggcacgactggggttggttggggcctacagtctccttgtccctcacagtctgcccctgtcagggctcggtcctcagagtaaggaaaggaaatggaagtcaggaggaagggaagatgtgagtgtgcggtgcgggtggcaaaagcagccttcggggcaaccccgtgagcgtcattgccaccaaaggctggctgttcccttgattccttgcataattgctctttaaaaccagtatgcacgccagtgccaagctcttcagcagcctgtccttgggtagtaagtgctgtggtctgtcaggactgatggccagcagctgtttctatgttgggcttttaactttttttattttatttatttatttatttatcttttttgagatggagtctcactctgtggcccaggctggagtgcagtggcgcaacctcggctcactgcatcctctgcctcctgggttcaaacgattgtcctgcctcagcctcccgagtagctgggattacaggtgcctgccacaacacctggctgatttttttttgggtatttttagtagagacagggtttcaccatgttggttaggctggtctcaaactcctgacctcaagtgatccaccacttccgcctcccaaagtgctgggattacaggtgtgagccgccatgcccggccgggcttttaacttttaatgtcctaatgttaaggtaattttgttgtgtgtttagaagtgaccttacctttaacacctgtggagttagtgcgtgcacattgctggctcagcgtaacccatcacgggaccggaggagaggagagcggggaagaggagagcagcttcaggccgtggtgtctcccacgtctgtgttcttatttgcagctcagggtttgcattcccaggtagaacaggtgtcgtacactgtgaaatgttccaggttatttgtttataatgtgtgtgtcatatacagatagctccaatgacatctgaagttgtgacttcatcatcttgtcatatttctgtatgatgagccccagggcccatcctgaggtctgctagccatgtgcttagtctcacctccccagcccacgctggcattaccacccagagacccttcagtgctgtgtgtttttcctttttagggttacttttgactcacagtgttaggcaagccagcttggaagttaacttttaaaaaaattcaattgaagctgtaaagtataatatatagattggaagtcaccagaaattgttttagtttgtgaattcccccagtgtatgttctgaaaagaaaatgggagagcttgtaaagcatctcctaaatgcgaagccgcgtgaccctggacttctggcacatctgataactgtctntctggagtggcaaaaccaaaaaaaatttggggggggccaaaatttaacttttgggcggccaagaagaatgcaatgtaagacacggtagtgggttcacaaaaggggcgggtgcacgagggggcgaacagcgc

SEQ ID NO: 416285 - DNA, 392 bp, Homo sapiens
ccatatttttttaatggctgccataatatttcaagtatgaatatagcataatttataggcagtctccctcttgaaaaaatgtataaatgggaaaatgctttccccaaataatgtggatgtgaaaattcttatacttctatacttggtatttctgttgagcaggttcctataatgggtatttcctaggtcctagttcatgtgcattttaaattttgatcacttctgccaaactaccctcagaaaaggtttgaccaaagttgccatctcattaacaaattatgacctgtttctcttgtccgttgtcactggatagtgtcttttttttctccctgagacggggtcttgctttgttgcactccagcctgggcgacagaaaaaaaaccgtctcacaa

SEQ ID NO: 416286 - DNA, 452 bp, Homo sapiens
attaccatatcatagaaatttacttttttaacacaaaaatggaatattgtgcactactcagtagcttgttttttttcgctcagtggtatctcatgaataaccttccatatttttttaatggctgcataatatttcaagtatgaatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgccgttgtcactggatagtgtcttttttttctccctgagacggggtcttgctttgttg

SEQ ID NO: 416287 - DNA, 2161 bp, Homo sapiens
atatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416288 - DNA, 1159 bp, Homo sapiens
tgcacatgcgcgccacctccgcactgccctggcttcctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagctttcacagcattgaaaagatcattggctggtggctctgactgtttccggctatgacgatgtaccactcgggaccctttctctggatgtttgccatctaatatgtataaaaagatcagaaatatgaaaaaaaggtaacaatgacattaacacttggtctcatcattatcacacaagtaggcttatgctgccacttccatggcagagtctgagttagtcctgaaataattgatttttatattatgaagtttattaacttttttccctt

SEQ ID NO: 416289 - DNA, 1076 bp, Homo sapiens
tgaattgtggtgctagctacacaaccatccacatttatcaaacttattgaaccatatacttctatttattgattcatagacagattttcactctgtcgcccacactggagtgcagtgtctcgatctctgctcactgtaacttctgcctctcagcctcaagtgatctgcccacctcagccttccaaagtgctgagattacagtcctgagccactgctttcggccttacagaattgttttgttttggggcattcagaagtctgacataaaaattaacttgagacttttatgttcattctttttatcttccattttctttccttccttgctttaaaaataccttggacttattttctgccctcgattttatttacttctttaggcattcagataccaaaacctcgtcctctacctatgcttgcgaattgagtcacagcttgtggtttaccttatttccccaagtccatgctcagttgatgtgatgatatagcgctccctcagctttcccctctttccccagtgctcatttatgacccgtctgtgtgttcatttccccttccccataactggcatcatgctctgtccatagtagacattcaggaagtgtgaatttcataagggaatgttggttccttttcttgccttttcaggcagtgtccccctagaacccgttttctacttttttggttttctttgtatcccttaaaagagtttttctaatctcaacttctaagaccttttttcttgtgtatttttgcagtttgcctccagattgatatgtctgacacttttaacctagttgaatattttacttgacaacatagcagtaccagtgagatagttcacttccttctttctcagaatgtctgatgataaactgtgcacattccaaaatcatgaattctgtctaccttcctcacctcccagtatttgattgtgttagtctcctctccattgtttgtgttctttgtcttctgtgaaatgccttgcagatcatcagcacattgtttcttttgacattagtgttcagtattctcccatacctggattacagtggatccatcttccattcaaatga

SEQ ID NO: 416290 - DNA, 910 bp, Homo sapiens
tgcacatgcgcgccacctccgcactgccctggcttcctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccagctttcacagcattgaaaagatcattggctggtggctctgactgtttccggctatgacgatgtaccactcgggaccctttctctggatgtttgccatctaatatgtataaaaagatcagaaatatgaaaaaaaggtaacaatgacattaacacttggtctcatcattatcacacaagtaggcttatgctgccacttccatggcagagtctgagttagtcctgaaataattgatttttatattatgaagtttattaacttttttccctt

SEQ ID NO: 416291 - DNA, 492 bp, Homo sapiens
agactctgtctcccaaaaaaaaaaggaacatgctctctcattcaaggttacccttctatcactccaaggattcactccataatcttatctttcttgatatgttacattcactaaaacgttcacatcaaatcaagtttgtagacacttgtccttaccaccttacaaaaagtgagatggtatcaacagaggtgagacactgctttacctgcatgtcacttttggcagctttcacagcattgaaaagatcattggctggtggctctgactgtttccggctatgacgatgtaccactcgggaccctttctctggatgtttgccatctaatatgtataaaaagatcagaaatatgaaaaaaaggtaacaatgacattaacacttggtctcatcattatcacacaagtaggcttatgctgccacttccatggcagagtctgagttagtcctgaaataattgatttttatattatgaagtttattaacttttttccctt

SEQ ID NO: 416292 - DNA, 272 bp, Homo sapiens
ggtttatacttaaatgctttcatgtttaaatgttgcaggacaaagcagttccaattccagagaaaatgagtgaatggggtggaaaagaccagctatacggagaatcatcagtatggttagaagatatcccaggggaaacaaagagcctggggggaaaggaggaaaagcggtctctagccttatgcaacgtacaccctttggactcagaactctcagtggactaacgtgggtcacctctgtgtagctctgctctgtgctggagagtcaaacct

SEQ ID NO: 416293 - DNA, 2360 bp, Homo sapiens
atatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgtaaaaaaaaaaaaaaaaaaaaaaaaaaaaaaaaaaaaaaccgggggggtcttatgggggggggggaaaaagaggggaaagaaagggggacaggggcaaaaggggtcccggagacccggtttccgggaaccaagggggaaaactcggggggtcccccaaagggggggcggataaaatgggaaaaccgggggaaccgggataa

SEQ ID NO: 416294 - DNA, 2797 bp, Homo sapiens
tgcacatgcgcgccacctccgcactgccctggcttcctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416295 - DNA, 2816 bp, Homo sapiens
tgcacatgcgcgccacctccgcactgccctggcttcctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggtgatttctgcctttgcaggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416296 - DNA, 2584 bp, Homo sapiens
ggaatgcaacagcgtggtctcggctcactgcaacttccacctcccaggttcaaaggattctcgtgcctcagcctcctgagtagctgggactacaggcatgtgacactatgcctggctaattttttttgttatttttaagtagagacggggttttgccatgttggcccaggcaggtggatcacttgaggccagaatttgagaccagcctggccaacatggcgaaaccctgtgtcactcttttagacccttctgagtgtttgcaggttgagtgttcacagggtgttagcctattgagctttcttttgtggttcttatgcaggtgatttctgcctttgcaggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416297 - DNA, 2804 bp, Homo sapiens
caggagttcaagaccagcctggcaaacatggtgaagccctgtctctactaaaaatacaaaaattagctaggcatggtggcatgtgctgtagtcccagctactcgggaggctgaggcaggagaatcgcttgaacccgggaggcggaggttgcagtgagccgagattgtgccactgcactccagcctaggtaacagagcaggactccatctcagtcaatcaatcaatcaatcaatctcagcggttgaactacccttgacatggttcagctctgtatccacacccaaatctcatgtcaaattgtaattcccagtgttgtgggagggacctggtgggaggtgattggctcatgggggccgacttcccccttgctgttctcgtgatattgagtgagcgcttgtgggatctggttgtttaaaagcgtgcagccctcccacttcactctctctgtctctcctgctccaacatggccagacgtgcctgcttccccttcgccttctgccgtgattgtcagtttcctgaggcctccccagccacgcttcctgtacagcctgcagaactgccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416298 - DNA, 2694 bp, Homo sapiens
tgcacatgcgcgccacctccgcactgccctggcttcctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416299 - DNA, 2122 bp, Homo sapiens
atatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatttattagggctgactctccgtgtccgcttcctggaa

SEQ ID NO: 416300 - DNA, 2069 bp, Homo sapiens
atatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccgggccgatttgtttttcctctagactcggctcatgcccat

SEQ ID NO: 416301 - DNA, 1588 bp, Homo sapiens
  misc_feature (2)..(2): n is a, c, g, or t
  misc_feature (89)..(90): n is a, c, g, or t
  misc_feature (145)..(145): n is a, c, g, or t
  misc_feature (183)..(183): n is a, c, g, or t
gncctgggatgacagcgccagggcagctggggccagggcctccatgtcaccgcactgtagaggccggtcttggtgtcccattttttttnnccccacaaaaaaaacccccggagaggggaattttccccccccccccctttgggtnttttaatattttttttttggggggcccccgaagagggnttttttttgggggggaagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggctgagagaggcgggactgggtcaagtgggtggagctcctccttgcatgactgcaactgtcggggctttccgccggctcacagcagttggggccagcggggagaagagaggcggaactgctgtgtcctcatgtggcgcagcctcaaactggcatccaggcactgggcccgtgcagagaaggcacctgcagagagcagggcagcccggcgcaggggcatgcgcctagaatcccagctactcggaaggccaaggcaggaggaccgcttgagtccagggattcaaggccaacctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416302 - DNA, 493 bp, Homo sapiens
  misc_feature (27)..(27): n is a, c, g, or t
atgctgatggctgactctagaggatanacaattcggccctgggcaatagagcgagaccctgtctcttaaaaaacgatgatgatgaacacagaggacggggcactgtgctgggagccagggggcctgggaggagccgagaccagccttttacctcggggttttgaggccaacagggacgacagagacagtttctagttagagccttggctccatttttggatgatttagccccgagttcctgagtctattttatgccccttacgtactttgatagaactaaggaaatagtggttttgagtgaagggaaaggaaacccagaaacattttacgttgcttttacttctgtagtgtagattgccccggcccctctctgagccctgtagcatctgtgatagcttctgtcccttcatcggttcatgtcacagggattttctttcccaggaagcggacacggagagtcagccctaataaatgagcacatgccctggctgta

SEQ ID NO: 416303 - DNA, 1539 bp, Homo sapiens
atatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgtggacctggtcccaggctcagtgaggagatggcctcagctgtggggctggtccatgttgcccactcactccagtgggaagtggggaccacgccatagagggtctgctcccactgcagctcccggtgctctcgtgttctgggaaggcctgggtgtgtgcacaaggaggcccgggccagggacttcaccaggggctgggtcacaagggcacagggtgtgtggaaagcgctgtgggggaagagccggtcaccggagagtgagcaggcggagactccaagctgggctgagccagagcagaaggcgagggattcccagccggacgggggttctctcaccaacagctgtgatttcatcccgaagtggaagggggtctaaacagaacaggccggcatggaggaaggactccaagggaccgtctggcaccgccgggctgataggaacccatcttgtctgtctgtgaattattcatgtgctgcacttcctgaaaagaatgctcctgtttgact

SEQ ID NO: 416304 - DNA, 943 bp, Homo sapiens
atatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacaccctt

SEQ ID NO: 416305 - DNA, 1460 bp, Homo sapiens
atatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggacaaagcagttccaattccagagaaaatgagtgaatgggcacctcgacctcccccagaatttgtccgagatgtcatgggttcaagtgctggggccggcagtggagagttccacgtgtacagacatctgcgccggagagaatatcagcgacaggactacatggatgccatggctgagaagcaaaaattggatgcagagtttcagaaaagactggaaaagaataaaattgctgcagaggagcagaccgcaaagcgccggaagaagcgccagaagttaaaagagaagaaattactggcaaagaagatgaaacttgaacagaagaaacaagaaggacccggtcagcccaaggagcaggggtccagcagctctgcggaggcatctggaacagaggaggaggaggaagtgcccagtttcaccatggggcgatgacaatgtttgccacagcctctgcctggaacctggctcgtgctgtgaccagaagggaaaggcggctgtttggctctttctcccccgcaaggacccgctgacccgctggatggagagcaaaggagacccctcccgagccgctcacagtcctgtatttggcaggtttgggagcctgaggggccatctccctgacactcagaggcactgccttgcagacaccatccgtgctcctggtaaagggggacagagagcctcaccttgccacatatttgaacagtgatgagtttggggctggtttctgggaagggaacgtttatttagtaaagagcagaacacccttgcgttttgttgggacatgtggaccgtgagtcgcaaacactctggagaaggctgagatgccaccattcccacggggactgaagacacattacgctcagtgaggagatggcctcagctgtggggctggtccatgttgcccactcactccagtgggaagtggggaccacgccatagagggtctgctcccactcgtgttctgggaaggcctgggtgtgtgcacaaggaggcccgggccagggacttcaccaggggctgggtcacaagggcacagggtggggaagagccggtcaccggagagtgagcaggcggagactccaagctgggctgagccagagcagaaggcgagggattcccagccaccaacagctgtgatttcatcccgaagtggaagggggtctaaacagaacaggctgagagaggcgggactgggtcaagtggcgggctgataggaacccatcttgtctgtctgtgaattattcatgtgctgcacttcctgaaaagaatgctcctgtttgact

SEQ ID NO: 416306 - DNA, 2351 bp, Homo sapiens
tgcacatgcgcgccacctccgcactgccctggcttcctgcgcctcttcaggtcatcgcttgctctcgttcccaggctttggcctctagtggacgagaatcaccgagtctgcggggctggacgctgactgcccgggccagcacctaggcgggcgggagctgtgcggcccagggttcacgcgggccgggtagaggctcgagccgggacccccgagcgtgaaccccggagccggcggcgctggggccagaggggccgggcgggaggtggtggcggaggcgaaggggcgacgggacctgggcctggcccgtgtgtgtcctcggcggcctggcgccggccgtcgctgtacggtgagccccagggaggcggatctgggccccgagaaggacccccgcctggatttgccccgtaggcccggcccgggcccctcgggagcagaacagctttggtgaggtggacaggaggtgacctcgcgagcagacgcgcgcgccagcgacagcagcccgccccggcctctcgggagccgtggggcagaggctgcggagccccaggagggccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggtaagttagtagattatcacatgttaaaaaacactcatccccgacctttgggagtgactaaagagttgtttatatgtactcggtaccctcagtaacacctcccaacccccaaatatcactttccttcccacacacataccacatacatgaactcttttgttgattttacatttgatttacattggtagggattttttcattctaacctgtactggggacccagtcacttcctctttctccagcattatcggtcacttatttactccctcgccattagagaattgttgtgagttttttgtttgtttgtttgtttgtttgttttttggagacagagtcttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgagacttttatgttcattctttttatcttccattttctttccttccttgctttaaaaataccttggacttattttctgccctcgattttatttacttctttaggcattcagataccaaaacctcgtcctctacctatgcttgcgaattgagtcacagcttgtggtttaccttatttccccaagtccatgctcagttgatgtgatgatatagcgctccctcagctttcccctctttccccagtgctcatttatgacccgtctgtgtgttcatttccccttccccataactggcatcatgctctgtccatagtagacattcaggaagtgtgaatttcataagggaatgttggttccttttcttgccttttcaggcagtgtccccctagaacccgttttctacttttttggttttctttgtatcccttaaaagagtttttctaatctcaacttctaagaccttttttcttgtgtatttttgcagtttgcctccagattgatatgtctgacacttttaacctagttgaatattttacttgacaacatagcagtaccagtgagatagttcacttccttctttctcagaatgtctgatgataaactgtgcacattccaaaatcatgaattctgtctaccttcctcacctcccagtatttgattgtgttagtctcctctccattgtttgtgttctttgtcttctgtgaaatgccttgcagatcatcagcacattgtttcttttgacattagtgttcagtattctcccatacctggattacagtggatccatcttccattcaaatga

SEQ ID NO: 416307 - DNA, 2071 bp, Homo sapiens
cgatgtcaccatttctacctgccacgcatcggcgaaggttgggactcgactggtgtttgatcactatgggaaaatcatccagaaaaccccctacccccaccccagagggatgacagtcagcgtgaagcagttattttctacactacctgtgcgccataaggaatttcaaaggaatattaagaagacgtgcctgcttccccttcgccttctgccgtgattgtcagtttcctgaggcctccccagccacgcttcctgtacagcctgcagaactgccggagccctcatgacttcagtgacctgcttctgcccctctaggtctatcagccacagtctctgcaagtttccaagagcagcagaaaatgaacacattgcaggggccagtgtcattcaaagatgtggctgtggatttcacccaggaggagtggcagcaactggaccctgatgagaagatagcatacggggatgtgatgttggagaactacagccatctagtttctgtggggtatgattatcaccaagccaaacatcatcatggagtggaggtgaaggaagtggagcagggagaggagccgtggataatggaaggtgaatttccatgtcaacatagtccaggtaagttagtagattatcacatgttaaaaaacactcatccccgacctttgggagtgactaaagagttgtttatatgtactcggtaccctcagtaacacctcccaacccccaaatatcactttccttcccacacacataccacatacatgaactcttttgttgattttacatttgatttacattggtagggattttttcattctaacctgtactggggacccagtcacttcctctttctccagcattatcggtcacttatttactccctcgccattagagaattgttgtgagttttttgtttgtttgtttgtttgtttgttttttggagacagagtcttgttctatcacccaggctggtgtgcactggtatgttctcgctcactgcaaccactatctctcaggttcaagcgattctccttcctcagcctcctgagtagctgggattacaggcacatgtcaccacgcctggctaatttttgtatttttaatagagactgggtttcaccatgttggccatgctggtcttgaacttctggcctcaagtgatctgcccacctcagccttccaaagtgctgagattacagtcctgagccactgctttcggccttacagaattgttttgttttggggcattcagaagtctgacataaaaattaacttgagacttttatgttcattctttttatcttccattttctttccttccttgctttaaaaataccttggacttattttctgccctcgattttatttacttctttaggcattcagataccaaaacctcgtcctctacctatgcttgcgaattgagtcacagcttgtggtttaccttatttccccaagtccatgctcagttgatgtgatgatatagcgctccctcagctttcccctctttccccagtgctcatttatgacccgtctgtgtgttcatttccccttccccataactggcatcatgctctgtccatagtagacattcaggaagtgtgaatttcataagggaatgttggttccttttcttgccttttcaggcagtgtccccctagaacccgttttctacttttttggttttctttgtatcccttaaaagagtttttctaatctcaacttctaagaccttttttcttgtgtatttttgcagtttgcctccagattgatatgtctgacacttttaacctagttgaatattttacttgacaacatagcagtaccagtgagatagttcacttccttctttctcagaatgtctgatgataaactgtgcacattccaaaatcatgaattctgtctaccttcctcacctcccagtatttgattgtgttagtctcctctccattgtttgtgttctttgtcttctgtgaaatgccttgcagatcatcagcacattgtttcttttgacattagtgttcagtattctcccatacctggattacagtggatccatcttccattcaaatga

SEQ ID NO: 416308 - DNA, 556 bp, Homo sapiens
  misc_feature (553)..(553): n is a, c, g, or t
aaagagcacctagtatgtgcacagcattgttctagatactgtggggatatgaagtttaaacatagatcatgccctcattgggcttacatgctgttgaaaagataggatataaatccatgaaaatttttacaatgctatttattaacaatacatgacaagagtactagaaatgttacttgtgactattttgtctattctagccaagctggatgcctggctgtttctcagttatactaaatgagttctgctctcagggtcttcatacttgcccttccctctgcctgcaacactcttcctccagttttttttttttttttttggctctctccatcactttaggtctccattaaaactgtcagcttcagggaagttgccttccctgaccacaaccacactaattcaaataccaatccttccccgcctccgtttggtaactctctagtctcttatctcctttatttttcttcatttcgtttatttacttgacattatattttatatttattttgttactttcttattgcctctacctgcacgacaacacataaaaaanaaa

SEQ ID NO: 416309 - DNA, 473 bp, Homo sapiens
ttccctttgtagtccagttccaggatttctgtagagtggaaccagattgtgtatgttttgctcttttgtggaacatcatcagctggggtacagttctgacgtgcactttctttattcttttattgactacactatttctgaagtcacttggcacctcttctgatttcatacatttgtaatgacattagatattttctatattgtctgcattctatcctggaattcctaatctcctatttatttatatttttgtgaattggaattaaccctttatgctgtatattctgttgatttcaacaaattcatatcacatatttaccattataatattatacataatactttcatcacccttttaaatctattttttacccattttcatcatctccttaaatttctcgcaaatacagaatcactttgtgtgtttggacttctccagaatatcaaataaataacatattatgtagcttttt

SEQ ID NO: 416310 - DNA, 384 bp, Homo sapiens
gttacccaacacatagtagcactcaaatatttgttgaatgaattataaaaatgactacttgtactgttaattttgtgtattctagtgaattaaatctcttcggcatcatttactcccttaggtatttgactttgtgtcaaatgttttggcaaggataaaattataacagactttcttgaacaaccaaaatataatctattaaggattttccttcacttttgataaaataagaaaaaaggaaattaaaaccttgcatcctaatgtaaaatagaattatatggtgtttaatatcagtgtccctttagctattatattaaactactatagttaataaattttatcattattttgtatgttggtttttaaaaatttcataaagctata

SEQ ID NO: 416311 - DNA, 525 bp, Homo sapiens
ttctcagcactgtgctccttccttagcacccggctgctcatattactccacgactccacaccctccaccgcccgtaacatggggcaaaacgatcccagccccttgctccacacagggccattatgaacatcacgtgaaataagagataagcaaacctccaaaacgattcatacatttttggaaattttttatcctaaaggtatttttttttctttctttctccactcagagaaagacaagaaatcatttacttttgataaattatttcacggccatttcccccatgacttcatattcttaaaattctgattcactaaatatcaatttaaaaattcctaattccttgacatacaagtaaagtaaagtagaaatcaaaatgtaaaatttgtaagaaacctcttcatatagtcacattcctcaatttggtgttcctattttctataatcaaaggaagaaacagagaagagccaaccctatctggaaaattattatagtcaaatgaacaacagcccagcctaccacaaa

SEQ ID NO: 416312 - DNA, 508 bp, Homo sapiens
  misc_feature (15)..(15): n is a, c, g, or t
  misc_feature (49)..(49): n is a, c, g, or t
  misc_feature (79)..(79): n is a, c, g, or t
  misc_feature (108)..(108): n is a, c, g, or t
  misc_feature (115)..(115): n is a, c, g, or t
  misc_feature (126)..(126): n is a, c, g, or t
aaaaggggggggaanaaaaaattaaccgggggtaccatggagaaaattnggggtaacagaacaggccaaattggtaaanaaacccacatccgggggtaaaacgggaanaccccanccacccttaanccattccatcccccttttgtgttaacaacatttaagttattaagtttatttaatttatttatttgagacggagtcttggctctgttgcccaggctggagtgccagtgacgtgatcttggctcacggcaacctccgtctcccagattcaagcaattctcctgccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatcatacacagttgggctcttctgtttaagttttccttctgtaaaagttatttttgagaataccttaagtttaag

SEQ ID NO: 416313 - DNA, 1363 bp, Homo sapiens
tagttttaaagataatttattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagagccaggagaaatcagtattgttttatttggaaataaatcatctatatttatatgagtaaacattggtattttcatgtaacaatactggtatgcaataagtggtgtaatatgagttgttatggactgaatgtttatgtccctcccaaaactaattatgttaaaatcctcaccatcaatgtgatgttacttggaaatgaggcatttgggaggcaattaggattagatgaggtcatgagggtggagccctcgtgatgggattagtgcctttataagaagagacatcaggctgagcccggtggctcatgcctgtaatcccagcactttgggaggccaaggcgagtggatcatgaggtcaggagattgagacaatcctggctaacacggtgaaaccccgtctccactgaaaaaaaatacaaaaaattagccaggcacagtggcatgtgcctgtagtcccagctactcgggaggctgaaggagaagaatcgcttgaacccaggaggcggaggttgcagtgagccaggatcacgccactgtactccaccctgggcgacagagcgagactacgtctcaaaaagacatcagaaagcctgcttgctctctgcaccatgtgaggatgcaggaagaagccagctgtctacagaacaggaagagaaccctacgagaacctaaccatgctggcgacctgttctcagacttccagacttcagaactgtgagaagtaaattgttgtttaagccacccagtctatgatgttttgttatggcagccccagctaatatatggagtggaaagcctagatttatctactgggttcttttcctgtcagcagttcaacatgtgtagtagctttcagtctctgctgtttgtgccaaatatataagaaataaaatcagataacttttttgtaattggatcatacacagttgggctcttctgtttaagttttccttctgtaaaagttatttttgagaataccttaagtttaag

SEQ ID NO: 416314 - DNA, 1819 bp, Homo sapiens
ccgaccttaccccaggcggccttgacgttggtcttgtcggcaggagacagcaccatggtgggttctctctgagtctgggaattcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatt

SEQ ID NO: 416315 - DNA, 1927 bp, Homo sapiens
ggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatt

SEQ ID NO: 416316 - DNA, 1890 bp, Homo sapiens
gccagaaccaccgcacgatgttgctgtcggccacacagtgcttcagcagcgtgttcgacttccagtcgttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatt

SEQ ID NO: 416317 - DNA, 1858 bp, Homo sapiens
gtcttgactcatgggtgtattcacaaattctgttacttcaagtctttttcttttaacggattgatcttttgctagatagagacaaaatatcagtgtgaattacagcaaacccctattccatgctgttatgggtgaaactctgggagattctcctattgacccagaaagcgattccttcactgatacactgtctgcaaacatatcacaagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatt

SEQ ID NO: 416318 - DNA, 1804 bp, Homo sapiens
cccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatt

SEQ ID NO: 416319 - DNA, 1878 bp, Homo sapiens
cccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatt

SEQ ID NO: 416320 - DNA, 1476 bp, Homo sapiens
ggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagtatt

SEQ ID NO: 416321 - DNA, 1364 bp, Homo sapiens
ggtcccttggtggaaggtgggtgtgtagtcgtggtactttacgcctcggtgtttagggaggagcctaaggtaaggagtcagaaacggggagtaaccgagctgcggcttttatataaggtcagtggtaggtaaggaaggggccttaacctctgctggtgaccagaagcctgcatttctgcattctgcttaattccctttccttagatttgaaagaagccaacactaaaccacaaatatacaacaaggccattttctcaaacgagagtcagcctttaacgaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcagttagttctcttctgctgtcttcattgggggaggcgggaagttgttttgggtttttgtttctttgagtaaatggtttactgcgctacaaatgcacacacagaatattgttcaactgttggctgttaacatattgcaggctgagtctgaaacgcaggaagtgttttcagatagcacaagtcaacattattttgaaaagggagaaaagtccataaagtttttgagaatagtgtaacaatgtattggtcatcctaactttaatgaatgaacttaagccccctgagcctatcaccctcttttaggatccatctcctttctcggcatcaaaataactggccacagcaatattca

SEQ ID NO: 416322 - DNA, 338 bp, Homo sapiens
catatgcaacccactgcagtaccacatcatgatgtccaagaaactctgcattcagatgaccacaggggccttcatagctggaaacctgcattccatgattcatgtagggcttgtatttaggttagttttctgtggatcgaatcacatcaaccacttttactgtgatattcttcccttgtatagactctcttgtgttgatccttatatcaatgaactggttctattcatcttctcaggttcagttcaagtctttaccataggtagtgtcttaatatcttatctctatattcttcttactattttcaaaatgaaatccaaagagggaagggccaaagctt

SEQ ID NO: 416323 - DNA, 2995 bp, Homo sapiens
  misc_feature (2915)..(2915): n is a, c, g, or t
agcagtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgttactgatggtgtttttaatctagaatttgaaaaactttcanggcttacagatgtgtgtttatattgccaataatctgcgggaaaaataagatgctaaccgaggccacgtagcctggcctca

SEQ ID NO: 416324 - DNA, 867 bp, Homo sapiens
caacgatggtcctcagtcacgatggtcctcagctcaacgatggtcctcagctccaacgatggtcctcagctctcctcagtttttttaatcttttggccacatttcatccaattaccatcataccttttatacgttagatttccaaggaggtaagtgaatcacgtaatgggggtgaactgtacccagtcaaaataaccttatctgactttttctatatttttgatattttttctctaaatattaagtctttctcccaagctcatgtctattccttcctaaaagtcaaattgacatgaagtgaaaaatgatgtgttgcttctgaagacaatggattgcttggcatttgggatctttcctttaaaactgataatgcttccccaattcagttccatctacctgactgactagaacatttactgtggtacattttccaggtttgataggaaaatgctaagcgttgtatgacacagatattcttgctcacaggcactctaccagcctttgaaaaagtcaatttaggctggacgcggctgctcacgtctgtcatctcagcactttgggaggacaaggcaggtggatcacgaggtcagttcgagaccagcctgaccaacatggtgaaaccccatctctactaaaaatacaaaaaaatgagctgggtgtggtggtgggcacctgcaatcccagctactcaggcggctgagacaggagaatcgttgaatctgggtggtggagggtgcagtgagccgagattgcgccgctgcactcctgccttggcgacagaacgaaactctgtctcaaaaaaaaaaaaaaaaaggccaggcacggtggctcgcagctgtaatcctagcactttgggaggctgacgtg

SEQ ID NO: 416325 - DNA, 539 bp, Homo sapiens
tactactaaattcacggccgcgtcgacctttaaaactgataatgcttccccaattcagttccatctacctgactgactagaacatttactgtggtacattttccaggtttgataggaaaatgctaagcgttgtatgacacagatattcttgctcacaggcactctaccagcctttgaaaaagtcaatttaggctggacgcggctgctcacgtctgtcatctcagcactttgggaggacaaggcaggtggatcacgaggtcagttcgagaccagcctgaccaacatggtgaaaccccatctctactaaaaatacaaaaaaatgagctgggtgtggtggtgggcacctgcaatcccagctactcaggcggctgagacaggagaatcgttgaatctgggtggtggagggtgcagtgagccgagattgcgccgctgcactcctgccttggcgacagaacgaaactctgtctcaaaaaaaaaaaaaaaaaggccaggcacggtggctcgcagctgtaatcctagcactttgggaggctgacgtg

SEQ ID NO: 416326 - DNA, 329 bp, Homo sapiens
gggccccgtgttggcagatggtggccaagaagagggttgattgtactgcgtgggtgtctggtggcacagatggcagccatccctgtctgtggagccaacccccaggcaccctgtatgctgggcctctgggaaacacaaagccctcttgatgcaagaaactcacagtgaaaagggtagaaccagccaggcacggtggctcacgcctgtagtcccagcactttgggaggccgaggtgggaggatccattgagcccaggagttcaaggctgcagtgagttatgatcacaccactgcacttcatcctggacaacagtgagagaccctggctga

SEQ ID NO: 416327 - DNA, 3604 bp, Homo sapiens
  misc_feature (2411)..(2411): n is a, c, g, or t
agcagtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagaaagtttgttgaccttggtcactacgaaggagttggaactctcctttctataggttgccgtgattctaaagaccaacccacagctgtgacatccctgagactaccaccagagggcgactgggccccacagtagtacataatataggacctctcttggagataatggaagacttggaatttcagatggttccaccctaattgcattagcgttctttcttaacaggagaaaggcttcaagaaacaaaacagtcctcattcactggaacagggtttgagataccagcattaagtaaatgagattttgacttaacctggagtcaaggctctaatttaggactttacttcccactcattttcatgccacaaagtctatacaaagtaggttttcaaataattgcagaatcagccaggcacggtggctcacacctgtaatccctgcactttgggaggccaaggtgagcagatcacttgaggtcaggagtcttgagaccagcctggccaacatggtgaagccctatctctactaaaattacaaaaactagccggacatgggggtgtgcacctgtaatcccagctattcaggaggctgaggcaggagaatcgcttgaacccaggaggcggggttgcagtgagccgggatcacaccactgcactccagcctgggcaacagagtgagactctatctcgaaagtaaaataaataactgcagcattgccagttggaaactttgtcatgagcttacctcacggtgacagttacactgctcctttaaagagtcatttacataatttgttatcaaattattaaccacttttaaatagaataataactacatttgcctccataattgnagcagattactaattaacattttcgagaattaaactgcttgcttatgaagtagctattaaaactaaattgaaatgcaatggatagtttcttgtagatttaaaactgcattgtactgtactttgtctataatgaaaatgttctattcaataaggtatctttttttcttctttttggccaagatggcactaagtaaaatttaaatcgagagatggcataatccatgagtcagccagactttcagctggaaaaatctttagtaaataccttccttctaaattacagaaagtaacttttccatacacactgtaaacagcagacactctaacagagcatcggttatgctccatctcctaacctgaaggactcttgtcacacacccacctctgagaacccaagctcctcagtttttttaatcttttggccacatttcatccaattaccatcataccttttatacgttagatttccaaggaggtaagtgaatcacgtaatgggggtgaactgtacccagtcaaaataaccttatctgactttttctatatttttgatattttttctctaaatattaagtctttctcccaagctcatgtctattccttcctaaaagtcaaattgacatgaagtgaaaaatgatgtgttgcttctgaagacaatggattgcttggcatttgggatctttcctttaaaactgataatgcttccccaattcagttccatctacctgactgactagaacatttactgtggtacattttccaggtttgataggaaaatgctaagcgttgtatgacacagatattcttgctcacaggcactctaccagcctttgaaaaagtcaatttaggctggacgcggctgctcacgtctgtcatctcagcactttgggaggacaaggcaggtggatcacgaggtcagttcgagaccagcctgaccaacatggtgaaaccccatctctactaaaaatacaaaaaaatgagctgggtgtggtggtgggcacctgcaatcccagctactcaggcggctgagacaggagaatcgttgaatctgggtggtggagggtgcagtgagccgagattgcgccgctgcactcctgccttggcgacagaacgaaactctgtctcaaaaaaaaaaaaaaaaaggccaggcacggtggctcgcagctgtaatcctagcactttgggaggctgacgtg

SEQ ID NO: 416328 - DNA, 3038 bp, Homo sapiens
  misc_feature (2958)..(2958): n is a, c, g, or t
agcagtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaacacaacaccatctggcagcagatttcagcgggagcagccatggaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgttactgatggtgtttttaatctagaatttgaaaaactttcanggcttacagatgtgtgtttatattgccaataatctgcgggaaaaataagatgctaaccgaggccacgtagcctggcctca

SEQ ID NO: 416329 - DNA, 3133 bp, Homo sapiens
  misc_feature (3053)..(3053): n is a, c, g, or t
tccctcccctccccttcccttcccttctctgctgtgtttccattctagaagttctttccttcatcccctcgttgctcctgcagagcatttactctgacagtgccccccacccaaggctcgtggctgcctggctgttggatgacagtaatgcatgcactgcacgtctcccccagaggagtaatgccggggaccatttgtagatggatgggaactgaagcaaagcgtgcttcaatttagattccccaaactgccagagccccaataaaactagacaactgttgttacctttaacagagggtttgcttctattttcatgtgtaacacacaagcccatggccttgactgggcttggaggaggattgttagtgtttaggtattgtagtctctgaggcagatgcacgtgcgtctgctcaagtttaacatcagcagccgctctctcatattctgtgtctgtctttgctgtcgtagaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgttactgatggtgtttttaatctagaatttgaaaaactttcanggcttacagatgtgtgtttatattgccaataatctgcgggaaaaataagatgctaaccgaggccacgtagcctggcctca

SEQ ID NO: 416330 - DNA, 2658 bp, Homo sapiens
agcagtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagggctctggtaacttcgttaacgccaatggcaagctgcttcctgacgtgtgcaggcgtccaccctgacacttgctgcttagcatctgttttcttctccttcagattctcactaatatcaacagcaatgctgcatttctctctgctttcttttttcagaaaaggtgttttgttctttttcttcttatcttcaatcttctgaagtccaatagctttaagcctgtcctcaagcgtctgtaggatgaagtgcatatcctcgctctccagagcgctccagcggatgatgtatgggttgttcaacgacgtcttcacaaccagaggtctcgtcttacggagagatccccgccccggtgcttgaggagctgcagccattttgaaaatccttccaagaagcaaaatgacaacagaaaaaattcatgttagcgacaactgcatgacttaagaatatcttgactgtactctctgattcttatttatttatgtatttattttttgagacagaatttcactcttgttgcccaggctggagtgcagtggcacaatctcagctcactgcaacctccacctcctgggttcaagcgattctcctgcctcagcctcccgagtagctgggattacaggcgcccgccaccaagcccagctaatgtttctatttttttttagtagagacagggtttcaccatgttgcccaggctggtctcaaactcctgacctcaggtgatccacccacctcggcctcccaaagtgctgggattacaggcatgagccactgcgcccggcctgtactctgattctggataagctagagcaagcctgattatataagtccaattaggtgagcatacgcttgtcttccttttaaagattaagtaattttatttttccccatttttcttacccgattttgaatgctctacgaaggctctttaaaatactcaggactatgggtgagtagtgtttaattttccccatttttttatatgactttgtctttattcctatacaagcaatatgtgaaagttttaattattgcaatcatagtacaattccatttgtctatttcatttattaaaaatattctgtttctacttgttcataatt

SEQ ID NO: 416331 - DNA, 2080 bp, Homo sapiens
  misc_feature (2000)..(2000): n is a, c, g, or t
ttgcagattcggattcattagatctggggcagggccaggctctgcagctctaactagctcccgcgtgctgctcattctgctggtctgcagaccacactttgagtgcaaagtcgtttcactcctcttctacctgaacttctggatttgttttgtttcccctccaacaaggttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaaggttggactagtactacaatagatggatatttttatttctagaactctgacatcatcatttgttaatatttaatgatttctggaactgccattccaaagaagaataaaagcacaactcaagtgaaattgaagtagtcgataatcagaaaagatgacaaaagtccacatgtgacatttgtacgtttctagctagaatgttaaacttcatcctttttttactgttgacctatttgtgggagggatgaaaggctacaaagagcacattcttgtaattttcaaatttttgcctgtctcttgaagaggtattttttcacccttagaaaagggactgtttttctatggactaagtagaagttacagagtcatgtaagaaaatctttgctattgtgtggagagaaattgctgcatttctgtttcttaagtgatggtacatttgtccatgtaacagaacaaaagatccatttggaaattttttttactggtatcaccttacatggtatcactgggaacatttatggaatcaacacttctgtagctcagtgacaggtggtggttgtttaagtgcagagcaatattaaaatgtactggtgactagtacatgtatttctccataagcagagttgccgaatcaataaacatgcaagtttgtactttgatctttaccaggtcagtggattgcttcaaaagcagagttttgtgcaagcactcactgtgctctctgaaagagcctgaggccgggcgtggtggctcacgcctgtaatcccagcactttgggaggccaaggtgggcagatcatgaggtcaggagatcgagaccattctggccaacatagtgaaaccccatctctactaaaaatacaaaaattagccgggcgtggtggcgtgtgcctgtagtcccagctgcttgggaggctgaggcaggagaatcgcttgaacctgagaggtgaggttgcagtgagccgagatcgagccactgcactccagcctgggtgacagagcgtgagactccgtctcaaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgttactgatggtgtttttaatctagaatttgaaaaactttcanggcttacagatgtgtgtttatattgccaataatctgcgggaaaaataagatgctaaccgaggccacgtagcctggcctca

SEQ ID NO: 416332 - DNA, 3030 bp, Homo sapiens
agcagtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagggctctggtaacttcgttaacgccaatggcaagctgcttcctgacgtgtgcaggcgtccaccctgacacttgctgcttagcatctgttttcttctccttcagattctcactaatatcaacagcaatgctgcatttctctctgctttcttttttcagaaaaggtgttttgttctttttcttcttatcttcaatcttctgaagtccaatagctttaagcctgtcctcaagcgtctgtaggatgaagtgcatatcctcgctctccagagcgctccagcggatgatgtatgggttgttcaacgacgtcttcacaaccagaggtctcgtcttacggagagatccccgccccggtgcttgaggagctgcagccattttgaaaatccttccaagaagcaaaatgacaacagaaaaaattcatgttagcgacaactgcatgacttaagaatatcttgactgtactctctgattcttatttatttatgtatttattttttgagacagaatttcactcttgttgcccaggctggagtgcagtggcacaatctcagctcactgcaacctccacctcctgggttcaagcgattctcctgcctcagcctcccgagtagctgggattacaggcgcccgccaccaagcccagctaatgtttctatttttttttagtagagacagggtttcaccatgttgcccaggctggtctcaaactcctgacctcaggtgatccacccacctcggcctcccaaagtgctgggattacaggcatgagccactgcgcccggcctgtactctgattctggataagctagagcaagcctgattatataagtccaattaggtgagcatacgcttgtcttccttttaaagattaagtaattttatttttccccatttttcttacccgattttgaatgctctacgaaggctctttaaaatactcaggactatgggtgagtagtgtttaattttccccatttttttatatgactttgtctttattcctatacaagcaatatgtgaaagttttaattattgcaatcatagtacaattccatttgtctatttcatttattaaaaatattctgtttctacttgttcataattaaccttctagtgactgtatggtattaatcttctaacttgttactgttttccaaaatgctatctagttgggcttccatgcattcactcaacaaatattctaggcctggcacactggctcatgccttcagtctcagaatttcgggaggctgtggtggacagatcacttcagcccatgagttcgagaccactctgagcaaatggagaaaccctctacaaaaaatacataaattagctaagtgtgaggcgtacctgtagtcccagctacttgggaggctgaggtgggaagatcacttgagcccaggaggtcaaggatgcagtgagcgtgattgtgccaccacactccagcccagtaacacatctgaccctgtctgc

SEQ ID NO: 416333 - DNA, 2025 bp, Homo sapiens
agcagtacggcgggaggcactagagggagctgcggccgctccggcccggccccgagcaccgcctccccagccagcgccgccgcgatggcggaggacagcgagtctgcggccagccagcagagcctggaactggacgaccaggacacgtgcgggatagacggggacaatgaggaggagacggagcacgccaaaggaagtcctggagggtatttgggagccaaaaagaaaaagaagaaacagaagagaaaaaaggagaaaccaaattccggaggcaccaagtcagactcggcatctgattcccaggagattaaaattcagcagccttcgaaaaatcccagtgttccaatgcagaagttgcaggatatccagagagcaatggagctgctatccgcatgccagggcccagccaggaacattgatgaggctgcaaagcacagataccagttttgggacacacaaccggtaccaaaactagatgaagtcataacatctcatggtgcaattgaaccagataaagacaacgtacgccaagaaccgtattctttgccacagggttttatgtgggacactttagacttgagtgatgccgaagtgctcaaggagttatacacgttgttaaatgagaattacgtagaagatgatgacaatatgttccgatttgactattcacccgagttcctgttgtgggctctgcgtccaccaggctggctcctgcagtggcactgtggggtcagagtgtcttcaaataaaaaactggtcgggttcataagtgccatcccagcaaacattcggatttatgacagtgtgaagaagatggtagaaatcaactttctttgtgttcataagaagttgagatcgaaacgggtagccccagtgctaatccgagagatcactagaagagtgaacctggaagggatcttccaggctgtgtacaccgcgggagtggttcttcctaagcccatagccacatgcagatactggcatcgatcactaaaccccagaaaattggtagaagtgaaattttctcacttgagtagaaatatgactttacagagaacaatgaagctatacagacttccagatgttacaaagacttcaggtttgagaccaatggaaccaaaagatatcaaatcagttcgagaattaatcaacacttacctgaagcagtttcatctggctccagtgatggatgaagaggaagtagcccactggttcctcccccgggagcacattattgacacgtttgtagtggagagccccaacggtaaactgactgatttcctgagcttctatacgctcccctccacggtgatgcaccaccctgctcacaagagcctcaaagccgcctactcattctacaacatccacacagagacgcccctgctggacctcatgagcgacgcgctcatcctggctaaatcgaaaggatttgatgtattcaatgcactggatttgatggaaaataagacattcttggaaaaactcaagtttggtataggagatggcaatttgcagtattacctgtacaattggaggtgtccaggtacagattctgaaaagggctctggtaacttcgttaacgccaatggcaagctgcttcctgacgtgtgcaggcgtccaccctgacacttgctgcttagcatctgttttcttctccttcagattctcactaatatcaacagcaatgctgcatttctctctgctttcttttttcagaaaaggtgttttgttctttttcttcttatcttcaatcttctgaagtccaatagctttaagcctgtcctcaagcgtctgtaggatgaagtgcatatcctcgctctccagagcgctccagcggatgatgtatgggttgttcaacgacgtcttcacaaccagaggtctcgtcttacggagagatccccgccccggtgcttgaggagctgcagccattttgaaaatcctggaactcacgatggcgaatccgtggtcacctgaaggcaacagcaccggcgcccagtgcgcctgcgccgcgcgtgcgcagagccc

SEQ ID NO: 416334 - DNA, 1626 bp, Homo sapiens
ttactcaaacagaaagagctatgaataataataataataacgataccactaaagtaaaatatttgacactcacaagattaaaagctgaatacagtaatcttctcataatcatcaccgggatatgcagcactgtaatcaacgaattacacctgggaaaatgcgccgcgacgttaatgctgtaagtacccgggaaaagacgaaaagaactaaggaaatcataacctgatgggatcaagatgcgcgagtcttctccttcagattctcactaatatcaacagcaatgctgcatttctctctgctttcttttttcagaaaaggtgttttgttctttttcttcttatcttcaatcttctgaagtccaatagctttaagcctgtcctcaagcgtctgtaggatgaagtgcatatcctcgctctccagagcgctccagcggatgatgtatgggttgttcaacgacgtcttcacaaccagaggtctcgtcttacggagagatccccgccccggtgcttgaggagctgcagccattttgaaaatccttccaagaagcaaaatgacaacagaaaaaattcatgttagcgacaactgcatgacttaagaatatcttgactgtactctctgattcttatttatttatgtatttattttttgagacagaatttcactcttgttgcccaggctggagtgcagtggcacaatctcagctcactgcaacctccacctcctgggttcaagcgattctcctgcctcagcctcccgagtagctgggattacaggcgcccgccaccaagcccagctaatgtttctatttttttttagtagagacagggtttcaccatgttgcccaggctggtctcaaactcctgacctcaggtgatccacccacctcggcctcccaaagtgctgggattacaggcatgagccactgcgcccggcctgtactctgattctggataagctagagcaagcctgattatataagtccaattaggtgagcatacgcttgtcttccttttaaagattaagtaattttatttttccccatttttcttacccgattttgaatgctctacgaaggctctttaaaatactcaggactatgggtgagtagtgtttaattttccccatttttttatatgactttgtctttattcctatacaagcaatatgtgaaagttttaattattgcaatcatagtacaattccatttgtctatttcatttattaaaaatattctgtttctacttgttcataattaaccttctagtgactgtatggtattaatcttctaacttgttactgttttccaaaatgctatctagttgggcttccatgcattcactcaacaaatattctaggcctggcacactggctcatgccttcagtctcagaatttcgggaggctgtggtggacagatcacttcagcccatgagttcgagaccactctgagcaaatggagaaaccctctacaaaaaatacataaattagctaagtgtgaggcgtacctgtagtcccagctacttgggaggctgaggtgggaagatcacttgagcccaggaggtcaaggatgcagtgagcgtgattgtgccaccacactccagcccagtaacacatctgaccctgtctgc

SEQ ID NO: 416335 - DNA, 996 bp, Homo sapiens
  misc_feature (916)..(916): n is a, c, g, or t
tccctcccctccccttcccttcccttctctgctgtgtttccattctagaagttctttccttcatcccctcgttgctcctgcagagcatttactctgacagtgccccccacccaaggctcgtggctgcctggctgttggatgacagtaatgcatgcactgcacgtctcccccagaggagtaatgccggggaccatttgtagatggatgggaactgaagcaaagcgtgcttcaatttagattccccaaactgccagagccccaataaaactagacaactgttgttacctttaacagagggtttgcttctattttcatgtgtaacacacaagcccatggccttgactgggcttggaggaggattgttagtgtttaggtattgtagtctctgaggcagatgcacgtgcgtctgctcaagtttaacatcagcagccgctctctcatattctgtgtctgtctttgctgtcgtagaatcccagtgttccaatgcagaagttgcaggatatccagagagcaatggagctgctatccgcatgccagggcccacctgggtgacagagcgtgagactccgtctcaaaaaaaaaaaaaaaagaaagagcctgtacccgcgactaactagacttttctgctgttgtgcaaagttcagtttcttctcagcaacatcaaggatatatgaagaaaaggaaataaaaaactgtaaagtcaaaagagatgcctggtggaacttattcgtgctatcagggcattgatagtttgaatgtttttattacttatgcaaaattgcacatactcctctatgctgattttatcatgaaaactgtcatgtgtcatgctaatggaaaatgtcttatttgtaaataagtattcataattttgttactgatggtgtttttaatctagaatttgaaaaactttcanggcttacagatgtgtgtttatattgccaataatctgcgggaaaaataagatgctaaccgaggccacgtagcctggcctca

SEQ ID NO: 416336 - DNA, 482 bp, Homo sapiens
tgaaattacactttaatatttgattacttttcgttcagaagatattcacattgtaatttttctgggtgtctgtctaattacctgaatagcacaacaccatctggcagcagatttcagcgggagcagccatgggtaagtctctcgttgactttgaattaaaccagtttgcagcggtcgttcttcattctaatgccaagggtgggaaatagttcctgacattctcctagtttaaaccaaaccagaagttgtccagctgggccccgtgttggcagatggtggccaagaagagggttgattgtactgcgtgggtgtctggtggcacagatggcagccatccctgtctgtggagccaacccccaggcaccctgtatgctgggcctctgggaaacacaaagccctcttgatgcaagaaactcacagtgaaaagggtagaaccagccaggcacggtggctcacgcctgtagtcccagcactttgggagg

SEQ ID NO: 416337 - DNA, 373 bp, Homo sapiens
gaaataaagcctcacaagaaataaggtgcttatggtgttaagttacaatggaaaataatcaatggcatttgtatgcatgctgcatgtgtgatgtagatcagttcataggagatggggcaacaaataaatatcaccatggggatgtgatcatcaaaacccaggctgtggaaaactgtcagtcaagtttcttcaacatattgcaagaaaaatatgatggcttgaaaatctatagatgaagcaatttaacaaacctaccaatctcatttaatcttgattacttttaaaaaaagattaaaaagatgacagagaaagggtttaaaaatttgtaagacacggctggacgcagtggctcacacctgtaatccagcacttt

SEQ ID NO: 416338 - DNA, 368 bp, Homo sapiens
ctgcagaccttcatatgtgacagcatgaggtgagctggagagggtctggaccacatgagcacgagcacttctcatcaggagccacaagatctcgattcctgggctggcttccttacaaaacagccatctggcagctcacaaatcacttaccctctttgtggccatgagcccccctagcagtaaaaccaagtgaaacatatagacaaaatcaaaatcctaccctaatacaatatgattatcattattgcccttgatattactcacaaatcaatccactgtgaattgggttctgatgcacatccacatgtggtgtttttgtacaccactttacaaaacgcttcccatttccacttcaacaatgagcaaaa

SEQ ID NO: 416339 - DNA, 705 bp, Homo sapiens
catgcctctcccccttgggcaggcaaccctccctcctgatccctgaggcagagctgcccctgcctgcagttccaagtgagaatcagctgacagcaggatggctcacctgccactcagatcaaaacctgtggcttctgacatccaagatgtctgtggactttgaaaatgggcagggctggtctaaccactgcctcagccaagccagcctggcctacctatcttcagaggggctgagcttcaggcagcagtctctattggagggcattcctctgctagcttccttccttttctctcttcacatgtcttcttcctttctgtccctctcttccaactcatacgcttcttcagatccctcagaccagccttcagcttggatcattgcccaagaaaatgctgaaactatggcatgtcaggctgggtgcagtggctcacatctgtaatcccagcactttgggaggccaagctgggcagatcatttgaggccaggagtttgagatcagcctggccaacatggcaaaaccctgtctctactaaaaatacaaaaaaaaaaaaaattaggcaggtgtggtggctcacgcctgtaatcccagctactcaggaggctgaggcacaaggattatctgaacctgggaagcagaggtcgcagtgagctgagatcgcaccactgcacaccagcctgggcaacagagcaagactctgtctcta

SEQ ID NO: 416340 - DNA, 328 bp, Homo sapiens
taatttttgtttttatacaactatatttcagcctgcttttaaaatagtcaagtaattcttaatatccccttctgtgtctaaagtcactttggagaagcagcaattctgtcatttaaagtaggacctccctattagaatcagaaatgtaatacattgtaatactattttctactctcactgctatcactgaccattatgcattatttttccaaattgaaagcagcttaagtcaagcaaaaggcagtggcaaaagttgcgggcattgtgcaagcagcatgtattaaacaatccaggaaacttggcaacccccagagacacagatgttgcc

SEQ ID NO: 416341 - DNA, 366 bp, Homo sapiens
cacaaagtatctgaaacacaccccttccatttaattcaagtattacaataaattaaactaaaatttctgggatttttgtagttactagtaaaaattttggtttcttttgacttaattttattcttccaaacatgtattctattgtttgtagtttattagaagtataaaagtataaaaaatagtctttagttgtcagattttatagctgtaattgttttctttatgcatctcaaaggaggaaattctgtacctaatgctaaatgacgagttaatgggtgcagcacaccagcatgatgcatgtatacatatgtaactaacctgcacattgtgcacatgtaccctaaaacttaaagtataaaaaaaaaa

SEQ ID NO: 416342 - DNA, 559 bp, Homo sapiens
  misc_feature (196)..(196): n is a, c, g, or t
gagccagtcacagaaagacaagactgtaggatgccacttagacgagggacgtagagtggtcaaaggcatagagacaaagtggaatccatggttgccagggcatggtggggaagagatggagtgttattgtttaatgggtgcagagtttcagttttgcaatataaaaagagccctggctgggctcagtggctcacanctgtaatccccacactctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtaggctcaggagtggagaccacatttcttagggtagcagacagagttcttgatagtcctttctgccccacctaaactttttccatcccagctaggaatgactccaaggatcttgcttatttggggggctccct

SEQ ID NO: 416343 - DNA, 490 bp, Homo sapiens
  misc_feature (122)..(122): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416344 - DNA, 386 bp, Homo sapiens
  misc_feature (19)..(19): n is a, c, g, or t
  misc_feature (22)..(22): n is a, c, g, or t
  misc_feature (24)..(30): n is a, c, g, or t
  misc_feature (70)..(70): n is a, c, g, or t
ttctggtgtgttcctcccnggngnnnnnnnccaccaggttgcctaaggaggggtgaaccggcccaggtcngaaacggagcaggtcaaaactcccgtgctgatcagtagtggctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416345 - DNA, 639 bp, Homo sapiens
  misc_feature (267)..(267): n is a, c, g, or t
cactcacacctgccaccacacaatggggaagttggcccatgccagcatcaatatctagttggtaacattgttctctcattgtacaagaccttaccactgagggaaacacgtggggggaatctctttatatcacttcttaccataattgtatcacttcttaccatagccacaaatctgcaattatctcaaaagtaaaaactgtggttgggtgtggtggctcacgcctgtaatcccagcactttgggaggccgaggcgggtggatcacntgaggtcaggagttcgagaccagcctggccaacatggtgaaaccccgtctctactaaaaatacaaaaattacaaatagccagtgtcgtggtgcacacctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416346 - DNA, 654 bp, Homo sapiens
gctctcaactgggtccagcaaatggaacaaatgattgtgtttttggtgttactcaggggaggggaggctgatgccaagacagtaacctcagtctttgtagagggaaccccatatgctaaagagatatcgcttgagaatgcttcatgctcttgagcccaattctatgtgctccctgatggaaggacaggtaggtattgggtgaggtgagcaaccaacacttactgggtgcaccttcaaataggacaccttctgaagtccccctagcccaggcagcacagggcaggccttctttggtgccaccaagtgcaattgtgtttccttcttattttaccatctgctatgcatttctttccatatccatgcctataattccatgagtctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416347 - DNA, 508 bp, Homo sapiens
acatgtccccaaggcacagggtcctacggtcctggccactctgggaatggagccgtggccgcagggcaggtgtgaagctcaggctgacgtggccccgtgtcctctgacccttatggtcacattgcctctctgggcctgtttctttgtaaactggagtgcagtggcatgatcatagctcactgcagccttgatttccaaggttcaagcaaaactcccgtgctgatcagtagtggctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416348 - DNA, 531 bp, Homo sapiens
  misc_feature (240)..(240): n is a, c, g, or t
tattttaaaaggcacggtaagtaaccagctatttttcttttaaatgaccagtccatattccacatttatgctatatgcctggcccccagagctttcaatccttgctttattccataactaagcttccttgagttctatacctaactactcttacttacataatacttcttattattaaatggtgtctcagttcatggcaaatcagaaagaaaaataaaggttgggtgcggtggctcacanctgtaatccccacactctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416349 - DNA, 444 bp, Homo sapiens
ctctgctcagtgcgcggtctctcacacgtgttatcccagcactgggggagcgacgacagcaggtggatcaacaagatgcaggaggcagcgaccagcccgacccacgatcaatcgccaatctatctttactatacatacatacactgcgctgggtgttgtgcacggcacactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416350 - DNA, 452 bp, Homo sapiens
  misc_feature (106)..(106): n is a, c, g, or t
tatcgctgctccggtggtatcctcctctttaaatgggggtataggctgggtgggtgttcacgcctgtaatcccagcactttgggaggccgaggcgggtggatcacntgaggtcaggagttcgagaccagcctggccaacatggtgaaaccccgtctctactaaaaatacaaaaattactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416351 - DNA, 327 bp, Homo sapiens
aagaaacagggtcctgctctgtcacctagtaggctggagtgcagtggtgtgactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416352 - DNA, 359 bp, Homo sapiens
cctaagtggaactgctccggccattttaaaatttttctttacagaggcagggtctcactgtgttgcctaggcttgtctcaaactctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416353 - DNA, 396 bp, Homo sapiens
ccggctctgacttaggaggaactgagaactagagatctagatctgggacgctgaaatgtggatgctattctgaagtcatagaaatgaaggtataaagtgagaacagggtaaacccagcactctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcccacaacccacgcgcccacaacccagcgcccacgacccccgcgcccacaa

SEQ ID NO: 416354 - DNA, 648 bp, Homo sapiens
  misc_feature (106)..(106): n is a, c, g, or t
  misc_feature (494)..(494): n is a, c, g, or t
  misc_feature (523)..(523): n is a, c, g, or t
  misc_feature (527)..(527): n is a, c, g, or t
  misc_feature (531)..(532): n is a, c, g, or t
  misc_feature (535)..(535): n is a, c, g, or t
  misc_feature (540)..(540): n is a, c, g, or t
  misc_feature (546)..(547): n is a, c, g, or t
tatcgctgctccggtggtatcctcctctttaaatgggggtataggctgggtgggtgttcacgcctgtaatcccagcactttgggaggccgaggcgggtggatcacntgaggtcaggagttcgagaccagcctggccaacatggtgaaaccccgtctctactaaaaatacaaaaattactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcaaagaccccgtctctactaaaacactaaaatagttagccagtcatggtggcgngtgcctgtaatcccagctactcagaggcngagncagnngantcgcntgaacnngggagcggaggttcagtgagccgagattgcgccatgcactccagctttgagcttggactgttgctccaactgcagcgtcagctcctccacagctcagggat

SEQ ID NO: 416355 - DNA, 594 bp, Homo sapiens
  misc_feature (106)..(106): n is a, c, g, or t
tatcgctgctccggtggtatcctcctctttaaatgggggtataggctgggtgggtgttcacgcctgtaatcccagcactttgggaggccgaggcgggtggatcacntgaggtcaggagttcgagaccagcctggccaacatggtgaaaccccgtctctactaaaaatacaaaaattactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagactcccatctctccaaaaaaatttaaaaaccagccaggtagactgggcgcagtggctcacgcctgtaatcccagaactttgggaggccgaggcaggcagatcacgaggtcaagagttagagaccagcctgaccaacatggtgaaaccccg

SEQ ID NO: 416356 - DNA, 672 bp, Homo sapiens
  misc_feature (4)..(4): n is a, c, g, or t
  misc_feature (130)..(130): n is a, c, g, or t
  misc_feature (518)..(518): n is a, c, g, or t
  misc_feature (547)..(547): n is a, c, g, or t
  misc_feature (551)..(551): n is a, c, g, or t
  misc_feature (555)..(556): n is a, c, g, or t
  misc_feature (559)..(559): n is a, c, g, or t
  misc_feature (564)..(564): n is a, c, g, or t
  misc_feature (570)..(571): n is a, c, g, or t
aggnttaggcaagaggatcagtaagagactaggagtggtcagtggggtaaaggaaaaagaaagtgggctgggcacggtgtctctcgcctgtaatcccagcactttgggaggccgaggcgggtggatcacntgaggtcaggagttcgagaccagcctggccaacatggtgaaaccccgtctctactaaaaatacaaaaattactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcaaagaccccgtctctactaaaacactaaaatagttagccagtcatggtggcgngtgcctgtaatcccagctactcagaggcngagncagnngantcgcntgaacnngggagcggaggttcagtgagccgagattgcgccatgcactccagctttgagcttggactgttgctccaactgcagcgtcagctcctccacagctcagggat

SEQ ID NO: 416357 - DNA, 477 bp, Homo sapiens
  misc_feature (122)..(122): n is a, c, g, or t
  misc_feature (474)..(474): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgcgcaagcaattggggatccactagagtcngcc

SEQ ID NO: 416358 - DNA, 714 bp, Homo sapiens
  misc_feature (106)..(106): n is a, c, g, or t
tatcgctgctccggtggtatcctcctctttaaatgggggtataggctgggtgggtgttcacgcctgtaatcccagcactttgggaggccgaggcgggtggatcacntgaggtcaggagttcgagaccagcctggccaacatggtgaaaccccgtctctactaaaaatacaaaaattactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgaaaaaa

SEQ ID NO: 416359 - DNA, 1000 bp, Homo sapiens
  misc_feature (122)..(122): n is a, c, g, or t
  misc_feature (467)..(468): n is a, c, g, or t
  misc_feature (560)..(560): n is a, c, g, or t
  misc_feature (708)..(708): n is a, c, g, or t
  misc_feature (767)..(768): n is a, c, g, or t
  misc_feature (921)..(922): n is a, c, g, or t
  misc_feature (930)..(930): n is a, c, g, or t
  misc_feature (935)..(936): n is a, c, g, or t
  misc_feature (953)..(953): n is a, c, g, or t
  misc_feature (970)..(970): n is a, c, g, or t
  misc_feature (978)..(978): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgcagtggcacaatcttggctcanngcaacctctgcctcccgggctcaagcaatcctcccacttcagtctaagtggctgggactacaggcacgtgccaccaggcccagctaattttngtgttttgttagagatgaggtttgccatattgcccaggctcgtcttgaacaccggggctcaaggaatctgcccatcttcgcctcccaaagttctgagatagcaggtgtgagtcatcatgcccagcctccttgaagtttactaacaatngggataactgagggaagagaagtgacaattccactcagtctattagaggtctggatatnnggtagccacacaataactctaacttgacttctaaccattctatcttatgatttggaggctgtcttctgccagatttcgtggcttgagatgatatcttcgaacccttctttcactacctttctacccttaatgtgccaagcttgaacaggattnnattctgancactnntcgcctctgtgcgtccnagtactggtcactcgcncatcagtnttcagtgaaaccaattgggcac

SEQ ID NO: 416360 - DNA, 576 bp, Homo sapiens
  misc_feature (106)..(106): n is a, c, g, or t
  misc_feature (528)..(528): n is a, c, g, or t
tatcgctgctccggtggtatcctcctctttaaatgggggtataggctgggtgggtgttcacgcctgtaatcccagcactttgggaggccgaggcgggtggatcacntgaggtcaggagttcgagaccagcctggccaacatggtgaaaccccgtctctactaaaaatacaaaaattactgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctctataaagaaattttaaaaattagctgggcatagtggcacgtgctgtagttccatctactaggtaggctaaggtngggaggatcacatgagcccagggagttttgaaggctgcagttgagctg

SEQ ID NO: 416361 - DNA, 773 bp, Homo sapiens
  misc_feature (619)..(619): n is a, c, g, or t
  misc_feature (648)..(648): n is a, c, g, or t
  misc_feature (652)..(652): n is a, c, g, or t
  misc_feature (656)..(657): n is a, c, g, or t
  misc_feature (660)..(660): n is a, c, g, or t
  misc_feature (665)..(665): n is a, c, g, or t
  misc_feature (671)..(672): n is a, c, g, or t
gcatttcgcatctggatcattgagtctcaaggctccggtaagaagtctcccatagtgttgaagattccctggcatttctgctcttattggagaatcccttcctgctaactcaggttcgatgtgccttgggaaaaagggaggtggtaaggtatttgtataaaattctcatgtcatcttgttctaatccactcctgtaatcccagcactttgggaggccgagatgggaggattactagagctcaggagtttgagaccatgggccacatagcgaaaccttgtctctataataattagctgggtgtctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcaaagaccccgtctctactaaaacactaaaatagttagccagtcatggtggcgngtgcctgtaatcccagctactcagaggcngagncagnngantcgcntgaacnngggagcggaggttcagtgagccgagattgcgccatgcactccagctttgagcttggactgttgctccaactgcagcgtcagctcctccacagctcagggat

SEQ ID NO: 416362 - DNA, 600 bp, Homo sapiens
  misc_feature (122)..(122): n is a, c, g, or t
  misc_feature (449)..(449): n is a, c, g, or t
  misc_feature (453)..(453): n is a, c, g, or t
  misc_feature (465)..(465): n is a, c, g, or t
  misc_feature (469)..(469): n is a, c, g, or t
  misc_feature (472)..(473): n is a, c, g, or t
  misc_feature (475)..(475): n is a, c, g, or t
  misc_feature (491)..(491): n is a, c, g, or t
  misc_feature (496)..(496): n is a, c, g, or t
  misc_feature (498)..(498): n is a, c, g, or t
  misc_feature (505)..(505): n is a, c, g, or t
  misc_feature (510)..(510): n is a, c, g, or t
  misc_feature (583)..(583): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgagcnaatntttgtatttttngtanagnngnggtttcaccatgttgnccagncnggtctcnaactnctgacccagcagtcctcccacctccgcctcccaaagtgtttaggattacaggcgtgagccattgcactccgtnaaggatcctctagatcg

SEQ ID NO: 416363 - DNA, 615 bp, Homo sapiens
  misc_feature (122)..(122): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaaa

SEQ ID NO: 416364 - DNA, 580 bp, Homo sapiens
  misc_feature (122)..(122): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagctcgctatgttgcccaggctggagtgcagtggctattcacaggcgcgatcccactactgatcagcacgggagttttgacctgctccgtttccgacctgggccggttcacccgtcgacgcgtccgcgaatttaagtagtagtaggcggccgc

SEQ ID NO: 416365 - DNA, 1266 bp, Homo sapiens
  misc_feature (122)..(122): n is a, c, g, or t
  misc_feature (433)..(433): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtggnatcgcgcagtggtgtgatcacagctcactgcagccttgatctcccaggctcaattgatcccctcgccacagtctcctgaacagctgggactacaggtgcacaccaccacgctcggctaatatatatattttttaactttttagtagacatgaggtctcactatgttacccagacttgtctcaaactcctgagcttaagctcttctcctaccttgcaagtttatacgtttctcttctaaaatatattttatctccttgattgaacaacttcacgaaagcacactttgtgtatttttgccagcatctggaagatgtaaacctatcgcacagcagactgttcaactaaatgttgacgtgcttgagacaaaacttgcttaatttcttcaaggcaaggttcggcacaaacttacctctttacttcgtacttataacacacgaagctcaaaacccctttactaactagatctagcaagcacagtctatgcactgcagcagtagactcacttagtagctgcttgatatttccagcgagcttactgtacaaactttctaactcggctttaaactagacccaaacctaacttccccacatttcacacttcacgacatgacgaatccactaggcatctactcttaaccttttcactgtcaccacacaacttctaactcatggctccattagaacacattttgccctgactgcgctcctcaccccttacacctacgtataacgacaaccaccacagaccccacaatccctgaattttgcctggatgcccacacctgctcgcctcccagcctcttcaacctgctcatcttacatcgtcctcccga

SEQ ID NO: 416366 - DNA, 481 bp, Homo sapiens
  misc_feature (122)..(122): n is a, c, g, or t
  misc_feature (439)..(439): n is a, c, g, or t
  misc_feature (443)..(443): n is a, c, g, or t
  misc_feature (460)..(460): n is a, c, g, or t
  misc_feature (469)..(469): n is a, c, g, or t
  misc_feature (474)..(475): n is a, c, g, or t
  misc_feature (477)..(477): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcnccantcactccagcctgggcnacaagagcnaaacnncntctc

SEQ ID NO: 416367 - DNA, 742 bp, Homo sapiens
  misc_feature (122)..(122): n is a, c, g, or t
  misc_feature (451)..(452): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagcagtggcacaatcttggctcanngcaacctctgcctcccgggctcaagcaatcctcccacttcagcctctcccagcactgggattataggtgtgagccactgtgcctggctattatttttcttttcaagacccataggaattgttattgttgctttaagccattgatgtttactagatttacccaaatgttacctctttctatatccttcattccttcttccttgtcagatcaccctgtgataccaattccttacaccttttaaatgtttctttaatgagaatcttccgtagtaaactcagtttgtccgaaaa

SEQ ID NO: 416368 - DNA, 472 bp, Homo sapiens
  misc_feature (122)..(122): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgatcaggagatgtgtgtaatgacctactggtgtcccctaatt

SEQ ID NO: 416369 - DNA, 825 bp, Homo sapiens
  misc_feature (122)..(122): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtggtgcaatcttggctcactgcaacttccgtctcccggaaggatgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacag

SEQ ID NO: 416370 - DNA, 559 bp, Homo sapiens
  misc_feature (122)..(122): n is a, c, g, or t
  misc_feature (433)..(433): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtggncgcgcagtgcctgtctgtgtgccgacttctgtctctctctcacgtctctctctctctctctcgcatgggatcgcgcccacaacccacgcgcccacaacccagcgcccacgacccccgcgcccacaa

SEQ ID NO: 416371 - DNA, 584 bp, Homo sapiens
  misc_feature (122)..(122): n is a, c, g, or t
  misc_feature (433)..(433): n is a, c, g, or t
  misc_feature (437)..(437): n is a, c, g, or t
  misc_feature (449)..(449): n is a, c, g, or t
  misc_feature (453)..(453): n is a, c, g, or t
  misc_feature (456)..(457): n is a, c, g, or t
  misc_feature (459)..(459): n is a, c, g, or t
  misc_feature (475)..(475): n is a, c, g, or t
  misc_feature (480)..(480): n is a, c, g, or t
  misc_feature (482)..(482): n is a, c, g, or t
  misc_feature (489)..(489): n is a, c, g, or t
  misc_feature (494)..(494): n is a, c, g, or t
  misc_feature (567)..(567): n is a, c, g, or t
tgaggttaaagcagacatttaatcggcaaaaaaaatttaaatagaattaaatattcaggctgggcgtagtggctcgcgcctgtaatcccagcactttgggaggccgaggcgggtggatcacntgaggtcaggagttcgagaccagcctggccaacatggtgaaaccccgtctctactaaaaatacaaaaattagccggtgtggtggcaagcgatcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagagcnaatntttgtatttttngtanagnngnggtttcaccatgttgnccagncnggtctcnaactnctgacccagcagtcctcccacctccgcctcccaaagtgtttaggattacaggcgtgagccattgcactccgtnaaggatcctctagatcg

SEQ ID NO: 416372 - DNA, 774 bp, Homo sapiens
  misc_feature (648)..(648): n is a, c, g, or t
tattcgtcaagaagagagttacattccccaatctaggtgtttgaaagaagaatatccctagtaaatgacattgaagcttaaacctaaactatgtatagcactcagctagaaaaaacaggccagaaagaatatttcaggtggagagaaacacatgttttcaggcccaaagctggagaaccaggtgagtttaaagaactgaaagaggtttagtgattaccatgttgaaccaaagggggcatgtggaatgaataagaagaatggttttgtagattgaattctctgcagccaactccatcaagaggtagaggtcaggcatggtggttcactttggaaggccgaggtgggcaggagttcatgatcagcctgggcaaaaaagtgagaacccatctctacccaaaaaaatgttttaattagctgactgtggtggtatctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtggncgcgcagtgcctgtctgtgtgccgacttctgtctctctctcacgtctctctctctctctctcgcatgggatcgcgcccacaacccacgcgcccacaacccagcgcccacgacccccgcgcccacaa

SEQ ID NO: 416373 - DNA, 958 bp, Homo sapiens
  misc_feature (728)..(728): n is a, c, g, or t
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcaaaaaaaaaaaaaaaaaaaaaaaaaaaaatttttngggggctgtgggccccggaaaaagttttaaaacacttgggggggggggggggcccagtgggtaccgtgaccgtgggccacaaggggtcccaagggaaccggggccggaccacggcgtgggttctccccaataaaaaagcccggggcaaccggaggcgtttggaaaatccgagggggtccgagggcaagggcccacaagagggccaggagcgaaaatcgggcggggggggc

SEQ ID NO: 416374 - DNA, 381 bp, Homo sapiens
ctactactactaaattaacggccgctcgacctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcaaaaaaaagtcgacgcggccgcaatttagtagtagtaggcggccgc

SEQ ID NO: 416375 - DNA, 1338 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416376 - DNA, 1146 bp, Homo sapiens
cgagctcggtacccctccttccctgccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416377 - DNA, 1148 bp, Homo sapiens
ctgaggatccccgactacctacttccgccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416378 - DNA, 1532 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctataaaaaaaaaaaaaaaaaaaaaaaaaaaaaaaaaaaaaaaaaaaaagaaaaaaaaaaaaaaaaaaagagaagagagagagagagagaaaaaaaaaaagagaagaggagagagagaggaggagagggtggaagagggggagtggaagagaggaggaaagaagggggagggggggaggggggggggtggggggaaagt

SEQ ID NO: 416379 - DNA, 718 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactccacccccacgtcgtcttatccttgt

SEQ ID NO: 416380 - DNA, 862 bp, Homo sapiens
  misc_feature (778)..(778): n is a, c, g, or t
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcctaccctgtcgggggcgctttccctgttggccgggggggacaacttgtttaaataccaaggaagaggttttagaaggagaggcgntggattgaccccattttggataattttgtggttaccgctcccataggtgtaaaaggctggtttgtgtttttgttttacccctac

SEQ ID NO: 416381 - DNA, 729 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcaaaaaaataaaacaaattggcctagattggtcttca

SEQ ID NO: 416382 - DNA, 1135 bp, Homo sapiens
tttttaggcccatttgaattttttggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416383 - DNA, 1147 bp, Homo sapiens
  misc_feature (18)..(18): n is a, c, g, or t
taaggtatgtctaggtcngtggccgggtgttaatttcgtgccgatgggccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416384 - DNA, 1147 bp, Homo sapiens
tctagaactagtggatccggctcgagtgttctcggagcactgtccgagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416385 - DNA, 1423 bp, Homo sapiens
cggagatgttaagagtggtctcaaacatcatagccaatgatgccccgtggcctatgatctctccgacggtaaaaccacatcaacacctcaggggccagcaaaccattcagcacagcttccttaactgtgagctgttcgaagctaccagtctgagcactatggactatttttttcaggctctgaatagcttccggcgggtgacattcagccggcggttcggggcgacggactctccattccagaaccatggcccaatttgtccgtaaccttgtggagaagaccccggcgctggtgaacggtggcgcatattaaggaattgcaaactaatttttgtgatctaaaaagaaaagtaacaccaaggcattggcagttctgtttggaactatctcttagagctttgtgtctgcttaaaggctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416386 - DNA, 1369 bp, Homo sapiens
cggagatgttaagagtggtctcaaacatcatagccaatgatgccccgtggcctatgatctctccgacggtaaaaccacatcaacacctcaggggccagcaaaccattcagcacagcttccttaactgtgagctgttcgaagctaccagtctgagcactatggactatttttttcaggctctgaatagcttccggcgggtgacattcagccggcggttcggggcgacggactctccattccagaaccatggcccaatttgtccgtaaccttgtggagaagaccccggcgctggtgaacggtggcgcatattaaggaattgcaaactaatttttgtgatctaaaaagaaaagtaacaccaagctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416387 - DNA, 1110 bp, Homo sapiens
cacacatacagatccattccaacttgaaaaaaaaaaaaaaacttgaggcattggcagttctgtttggaactatctcttagagctttgtgtctgcttaaaggctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416388 - DNA, 693 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaatcagctccactctttcatcctct

SEQ ID NO: 416389 - DNA, 1286 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416390 - DNA, 714 bp, Homo sapiens
  misc_feature (657)..(658): n is a, c, g, or t
  misc_feature (686)..(686): n is a, c, g, or t
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttgtttttttggaccccanngtggtggatccagacctgctaatcctgntattaaaaattaaagggtttttgtcaaa

SEQ ID NO: 416391 - DNA, 1218 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416392 - DNA, 1072 bp, Homo sapiens
gactacttaccttacaaaattgaaagttcaagggttctcagcagttgaagagaagtaatgttagtaattctcaactttgactaaaactgccttctagtttgaatagcatcttttatgttctttgtctccttaattctggaaaagaatagtttcaaatatatatatatatatataattatatatatatataaaaggtaccttaaaatgtatgcttcttttttcaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416393 - DNA, 952 bp, Homo sapiens
caaaattataaagtgagttagagttccttgaagttggttgtatacgggaatatgacttggacaatctttaccagaagccatccggtaagcccctcagtcacactttccatgtagctgaccaggtgactacaggatgtggctgacagtgctcactgaaagaagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416394 - DNA, 761 bp, Homo sapiens
  misc_feature (632)..(632): n is a, c, g, or t
  misc_feature (651)..(651): n is a, c, g, or t
  misc_feature (669)..(669): n is a, c, g, or t
  misc_feature (707)..(707): n is a, c, g, or t
  misc_feature (711)..(711): n is a, c, g, or t
  misc_feature (714)..(714): n is a, c, g, or t
  misc_feature (720)..(720): n is a, c, g, or t
  misc_feature (741)..(741): n is a, c, g, or t
  misc_feature (749)..(749): n is a, c, g, or t
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgacccccctccaccctccccctcngccgctgaccctggagcanctggaccggcacccgcancccccaaccccgcctaacccacggccccacagcccgtncccngcngcgaanacccgccacccgccccacaanttccacanaaccacacgagc

SEQ ID NO: 416395 - DNA, 740 bp, Homo sapiens
cggacgcgtgggtcgacccacgcgtccgatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416396 - DNA, 1112 bp, Homo sapiens
  misc_feature (628)..(628): n is a, c, g, or t
  misc_feature (903)..(903): n is a, c, g, or t
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagatcatacgcagccaggggactatcgcgtatgatgtctgaacaccaatgtttagcatcggcccagccacgagtgagcancagagcgctgttgcaccaggtgggatcgcactgcccggtccacgaagcatctccggcccccctcccccctctattttctcctctcccgccactcaaccgcggcccaacccgccgccgttgcctttgccgaaggactaacgcatgcagccccctgaaggtataggaggcaggagggagcacccccgcacaggcaagagggtccccacagcatcgaccgcgctaaatgtacctcccgtgccgagaagccgcggatgactttagtcgtacacgagttnacacgatcgccctctccgcccctatccccagaataagcgccccacccccctcgctgtcgctcgtttcacacgcgcgtcctaatagtgtgacaatgcttggaagcgtgtactgcgtgggtcataaatacacgcacgagcgtccagggaggtccagctccacccccgccgacggcgccgccagggctaagggccccacgcgcgcgcgaggg

SEQ ID NO: 416397 - DNA, 886 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggtaaccacgggctaaatgaaaacggatgtgcataacagaaaatgtcttcccttgggatttttctgattgttttgattaatatatatgtttccaatgaggctgaatccagcataatgaggaaaaaaattttgactgctgaggaagatacttacttttctaattttgtcacctgggtagaaataattagcccattttatgtcttagtttcctaagagtcttaaacctagcaaaaaagtgaccatttttattgggaaattttttttcctttcctatattagatagtatactaaaatatgatggcttgctttgctgagtctgtacttttttcatctggagtcctgagattgtccccaattcagccaaaacatctcttgaactatgtcacagtcaggaagc

SEQ ID NO: 416398 - DNA, 963 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaagaaaaaaagcagcacctgaggattctgaacagttctctgctcagtgatgatcaagccttcctttggacaagcttaaataactcagccactgttctttgttggaggactttgggactactgatgcaatgtgtccacttgggggccctttggagaaaaaattgctaatttcagaggggcagccgcaccagtggttaaggaaatccctggggagaaaatgtttctgtctggattagagagaagacatcttatttactcattcaatcttcatgataatcttgtgaagctataattaatatccttatttttgcagattaggaaactaagacgtactgaggctgggtgcctggttcaagatcatatagctaacattattggacatgcaaatcaagcccagatttgtgactctgagctgatgttaattctgtcacaatattggttctcaagataaatctttccaggtgagggggaaaggga

SEQ ID NO: 416399 - DNA, 1150 bp, Homo sapiens
aagctggtaagcgccggaagtatgggatgtcttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416400 - DNA, 1165 bp, Homo sapiens
aattcgcggccgcgtcgacacggtgcgagaagacgacagaaggggcttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416401 - DNA, 739 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcaaaaaaaagtcgacgcggccgcaatttagtagtagtaggcggccgc

SEQ ID NO: 416402 - DNA, 1099 bp, Homo sapiens
  misc_feature (750)..(750): n is a, c, g, or t
  misc_feature (753)..(753): n is a, c, g, or t
  misc_feature (762)..(762): n is a, c, g, or t
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcaaaaaaaaaaaaaaaaaaaaaaaaaaaaaaaaaaaaaaaaaaaaaaaaaaaaaaaanaanaaaaaaaanaaaaacaaaaaaaaaaaaaaaaaaaaaagacaagaaaaaatgcagaggcgggggagcgggcactataaatttatcctgcggggggggccgcacattattgagatcccacatcctttgtgattggtggagcagcgagtctcccacatgatagcgatcgtttattcattaagacgaaccatggacgggcgggtcgatctattataaagcacgctgcggcttggcggacaccaagcacatgctgggttggtatctattggagggaaaaccacctttgttggggtcggtgggcgtcttggaggcaacacccccgcgaaatgaaggtcccgtcggggtatat

SEQ ID NO: 416403 - DNA, 1115 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcaaaaaaaaaaaaaaaaaaaaaaaaaaaaaaaaaaaaaaaaaaaaaggggggggggggcaaaaaaatacccccgagggggggccccgaattacgcggcggtcgccccgattttttgggcaccgaggggggcccccaaaggaggggcgcgcgcaatataagaggagggaggggaaggggcagcacgggtaaaaaagggggcggggggggaaaaacgcgctacacccggggacacctggggagagagaacccatatcacagggggggggaaccaatggtggccccaaatcccaaagaggattttaaaccgctagaggggagaattataaattttaaaggtggataaggggtgtgcacaggggggaattatggtggggtataaaaattttggcaaagaggaattatttagagaatttttaacgggg

SEQ ID NO: 416404 - DNA, 968 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcccccaaaaaaaaaacgagcaagcttatgcatgggggccggaatttgaggctacttggccatttgccctattgggagggggttacaaataactgggccggggtttaaaacacgggggtggggaaaccctgggggtcccacacttaaaagcttgaggagatccccctttgcagggtggggaaaaaaaaaaagccgcccccctcccttcccaacattgggagcctaaaggggaagaaaaattaacgctaatttttttttaaaacccgtcaattttttt

SEQ ID NO: 416405 - DNA, 894 bp, Homo sapiens
  misc_feature (707)..(708): n is a, c, g, or t
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcggacataaaaaccnnaaaatttttaaaaaacatgtgggccgccttggcccagtcgattttagacttgagcaagcttatgcattcggccggaattggggttacattggcaattggccctaaagcgggtcgattaccaattaatggcggggttttaaacgcctggatgggaaaaccctggggtacccaattaatcgctttgag

SEQ ID NO: 416406 - DNA, 719 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactctctcccccgtgtcgggcggccctctt

SEQ ID NO: 416407 - DNA, 1130 bp, Homo sapiens
  misc_feature (13)..(13): n is a, c, g, or t
tggccggggcccnccggcggtagttttttagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416408 - DNA, 1123 bp, Homo sapiens
  misc_feature (15)..(16): n is a, c, g, or t
agtacctatttgccnntaattaagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416409 - DNA, 1392 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacggcattggcagttctgtttggaactatctcttagagctttgtgtctgcttaaaggctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416410 - DNA, 797 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaattgccgtccgctccgaatcacaccaaacacccttagcctggtgatagcttatgcatggccgccgattaagggtccttctttccattcgggcctacgggacctttataaattttatgggcccgtaaag

SEQ ID NO: 416411 - DNA, 999 bp, Homo sapiens
ggggtctctccacaaggttacggacaaatggtgccatggttctggaatggagagtccgtcgccccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccaaagatatttaaacaaggttataatttagcatcttccctggatctaaatagtatattatatcctgaaataaatgaaatgattgctata

SEQ ID NO: 416412 - DNA, 686 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttcctctcctgcgacagacagcagactcgagccgagcttatcgatacc

SEQ ID NO: 416413 - DNA, 880 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaaggaagctgtgctgaatggtttggtggccactgaggtgttgatgtggttttatgtcggcgagtttatagacaggtggggactcattgtctacgaggtctgcagaccaaccggtaccgtgggactatgtttgacctcagacatggcccgttgcagcgacattagcccacccgcctgcatacccgagttgcgcacttcgcgccatccagtcttcgcccgtcaccgcccatctcggcgcgcctccgcaagtggccgtctccgcgatgaacgcttccgccctcgcacatgcgggcctccccatgtcttgcgcccctaggatgcgccttcgtcactccgcgccccccttgcctgaccacagccggtctcccctctcccgcggctcttccgcacaccc

SEQ ID NO: 416414 - DNA, 510 bp, Homo sapiens
cgagtggctgccccacaaaatgcctgcttctctgcggaatcctactgttcttcacatgctctctaataccatcttttcatatccactttctcttccatgttgaaaaattaaattgacaggctggattctgcaaagatctttggacatttaagtatcttcgaccggcgcgaaaagaggcggcctgaccttggaagtgggacggggtcctgcagcgggtccttccggcgggtgacattcagccggcggttcggggcgacggactctccattccagaaccatggcccaatttgtccgtaaccttgtggagaagaccccggcgctggtgaacgctgctgtgacttactcgaagcctcgattggccacattttggtactacgccaaggttgagctggttcctcccacccctgctgagatccctagagctattcagagcctgaaaaaaatagtcaatagtgctcagactggtagcttcaaacagctcacagttaggagttgtgatgttgtgcactg

SEQ ID NO: 416415 - DNA, 4596 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcagcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgcggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaaaaaata

SEQ ID NO: 416416 - DNA, 4507 bp, Homo sapiens
gagcccccggagaggcgggagcggtgttggcgttttggttctttttgttcattgagcgcaggcagctatgtcttcttcaaaggagaggagcaaagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcagcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgcggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaaaaaata

SEQ ID NO: 416417 - DNA, 838 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagtaactcctggactgtttctgtagcagccacacaagtctcctttatattgccaatatctatctttatcccaaagacaagatgaatgttcaaaaacgggtgtattatctcatatactttcagcactcagatttgataaagaagttgctcttttcactcaaggtcttgggtatgcacctatagattactatcctggtttgcttaaaaatgtgagtatttaaaatttatcacttt

SEQ ID NO: 416418 - DNA, 842 bp, Homo sapiens
agccatttctgtttaaaattttgtttatttctttctgaaaggaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggcacaattaaatcagctggtggcgtatccccgcatcgtgtgctgggcctggcgtcactgcctctgtggatgtccttgaggtgaagaacatgggtgcaaagaccaagcgtgtccccgcccaggatgtgtcctgcctgtgagaaggcctgtcccactcat

SEQ ID NO: 416419 - DNA, 392 bp, Homo sapiens
aaaataaggatcattccctttgatttctcttctttactagggttgttattagtttgttttgctatcattgcttgtcttatattccacataaactttgaaaccaatttttctagttgcagggaagacacccagtgttgttgggggaagactcctgtaagtatatagattatcgagagagctggcgttttcatgatgttaaggctgtctgtccgcctgttcaagaacacatacgttttaccatttgttaagcttttgtgatctgaagggagtgttgtatatatttttcacacattggatttacacatttcttgttcctaatgttttgttgtatttgtgttttcaatgttttcactgtcataaatggatcttctcctccatcttcaaaaaaaaaa

SEQ ID NO: 416420 - DNA, 4710 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgggtcttgccctgtcaaccaggagtgcagtggcacgaacatagctcactgcagcctcaaactcctgggctccaggaatcatgccacctcagccacctgagtaactaggactacagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcagcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgcggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaaaaaata

SEQ ID NO: 416421 - DNA, 4284 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcagcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgaatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaaaaaata

SEQ ID NO: 416422 - DNA, 3661 bp, Homo sapiens
caggcaggctccacggcatgcgggcagagggatgtttaaagtttctctaatacttactgattctgtattatggatcgcctgagcttttatagaaaatgtgggacatacaggagtatacagaggaataagctgcctgtaacccctgcccagggagaccaccgtatgcacttcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcagcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgcggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaaaaaata

SEQ ID NO: 416423 - DNA, 2348 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctgatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagaga

SEQ ID NO: 416424 - DNA, 1747 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctgcctcaagcagcctgccaccctgccatattccgggttgttgatgagatgttcaggtgtgcactcctggaaaccgatggggccctggaaatcatagccactattcaggtgtttacgcagtgctttgtagaagctctggagaaagcaagcaagcagctgcggtttgcactcaagacctactttccttacacttctccatctcttgccatggtgctgctgcaagaccctcaagatatccctcggggacactggctccagacactgaagcatatttctgaactgctcagagaagcagttgaagaccagactcatgggtcctgcggaggtccctttgagagctggttcctgttcattcatcctgcaaaacgaagacccttcttccccaaggtcatttgatctgttattgctcagctgccatatctgccccagggtcgcgtcctccaaggcgtgccctgcagaggcgggctgttctgaggggtgtgccggcagcagagcctggccacagccagggccctgtctcgctccccagcagcccggccagggcttgcttccatcttgactgtctcctttcttggatcagtcaacagatcctcacattactggctttatttacatctcttactaaagtaatcagatgatattaac

SEQ ID NO: 416425 - DNA, 1227 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagggtgtattatctcatatactttcagcactcagatttgataaagaagttgctcttttcactcaaggtcttgggtatgcacctatagattactatcctggtttgcttaaaaatatggttttatcattagcgtctgaactcagagagaatcatcttaatggatttaacactcaaaggcgaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctttgcagggaagacacccagtgttgttgggggaagactcctgtaagtatatagattatcgagagagctggcgttttcatgatgttaaggctgtctgtccgcctgttcaagaacacatacgttttaccatttgttaagcttttgtgatctgaagggagtgttgtatatatttttcacacattggatttacacatttcttgttcctaatgttttgttgtatttgtgttttcaatgttttcactgtcataaatggatcttctcctccatcttcaaaaaaaaaa

SEQ ID NO: 416426 - DNA, 792 bp, Homo sapiens
agaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccgatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggattctaatacagtcattgaaagattccccacaattggtcaactgttggcaaaagcttgttggaatccttttattttagcatatgatgaaagccaaaaaattctaatatggtgcttatgttgtctaattaacaaagaaccacagaattctggacaatcaaaacttaactcctggatacagactgaaacgtcacctcttcccgggtctaaagcctgctggccttctgactgaaactataccggtgactctcctggttatctgggcatttgctctcttgtgtctctgacttgctggctactgtaatggtgttagctgattccttataataaatccctgtgtgtgtgtgtgtctatcttattggttca

SEQ ID NO: 416427 - DNA, 588 bp, Homo sapiens
ctttggattttccatcctgtggcagctgcggtttgcactcaagacctactttccttacacttctccatctcttgccatggtgctgctgcaagaccctcaaggtgagttagggttgactttgcccacatcagaatgatttcctgggaagagcattgtcaaattatgacctcctcatcaggcccttatctacagcatgagggagacagaactggttatttctaagatccctttaagcccccaggatcccacattctgtggattttgatatgagagtctgcttggcttcccagttgtgatcacttaccaaaagaagaaaacaaacaaaaaaacaatggcctctggtaggtgttgctagtctgcctccagataacacaggctcttctggtgccaaccagatccaccagatgccaggaacaggctaagacttggctgagtcagaataaaacagtacattcgtttgcttttcattctttctactctgtgcagccttgttgcagaagaaaagacaaaatgatggatgaagctgaggaaatgcaggggaagtttcccctaaccaagctaagggaaggattttgagagagttcagta

SEQ ID NO: 416428 - DNA, 555 bp, Homo sapiens
caattctcatgttcgtgtgagccttttgcagaaagtcaagccacagcatgctcatttgcctttgttccccacagtggatcatcccacaacttgtgactggcattctgagaagcacttctgattgcaagcagcgcttgtttgtggcctttatgagtctaaggctgttggcagctgagctcaatgcgaggaggctcgttaggaaatggcaccgctcactgtgtagccagccttggagacagacttgctatgctaatcaccttgcaaactagagcccctgatgctttactttggaactgatggaaatgctggatagggcttctttcagggactgggtggttatggtccgtccctggacaaaggacaaatctgtctggaaagtgttttaatttgccttctcttctgtcctgattgcagatggctcacactgctgagataactcacgagatcattggctttcttgaccagaccttgtacagatggaatcgtcttggcattgaaagccctagatcagaaaaactggcccgagagctccttaaagagctgcgaactcaagtc

SEQ ID NO: 416429 - DNA, 1144 bp, Homo sapiens
tcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatata

SEQ ID NO: 416430 - DNA, 821 bp, Homo sapiens
tcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatata

SEQ ID NO: 416431 - DNA, 1414 bp, Homo sapiens
tcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatataaaaaaaaaaaagtggcgcggcggaatttagtatgtattactcaccgggattccggtctgtcgtgaggggacaagcttccaaaaagagcggataaacttgggtaccaggcaaaccgttcaggggaatgtttccggccaatccaaacaattgggcggcgaaaatgtaaccgggtccaacaggcccacgcataatggtgggccagcccgttcattggaactgttgccatgataaaaacgccacccgggaaggggttctttgggcaggtgtttg

SEQ ID NO: 416432 - DNA, 1211 bp, Homo sapiens
  misc_feature (1149)..(1149): n is a, c, g, or t
tcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatataaaaanaacaaaaacacaaaaaaaaaattttgggggggcctgggcccgaaaaaagtttttaaaacctg

SEQ ID NO: 416433 - DNA, 1729 bp, Homo sapiens
tcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatataaaaaaaaaaaaaaaaaaaaaaaaaagagggtgtaaaaaaaaaaaaaaaaaaaaaaaaaaaaatgttttgtgggcgcgcccgcccgcgcggcccccgagaaaagatttttcaaaccccttgcgtggggggcgcgcgcgggcccccaggagtgtaacgagagcaacagcggcggccacacgacggggctttccccagaggagaaaccctcggggcccagcacaagcggctgcggggatttccccaccacactaaaaaaagaccgccgcggggaaaaacagaagcgctgtgctgctacacacacactccccccagagggggggctctctcgagagccacccacaacggggggttcatcacaccacagcgggcggctccccaccgaggcagctccgctccgattaatcaaaattaacaaggcccccgcccgggtggtgagcctctcacgccgcgccatccgcatgccgcctccatcgccgcccgactccctcagctaaccagcaacccagcaaccacatccacgcagccagcacacagaccatcatcccatgctgaacacaccaaacgatcaacagtcaagacagacgc

SEQ ID NO: 416434 - DNA, 1195 bp, Homo sapiens
tcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgagggtccctgctgacccttccgtactcctggacccccttgacccctctatttctgttggctaaggccagccctggacattgtccaggaaggcctggggaggaggagtgaagtctgtgcatagatgggagagccttctgctcagaggctcactcagtaacgttgtttaattctctgccctggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatataaaattaacagtaagatggggagtgggggaccagaactgggatcctctaaca

SEQ ID NO: 416435 - DNA, 968 bp, Homo sapiens
tcagaccaatagtgattaggaaaccttgaagcctgcccaacgatcgtgggcaggaggtggtttctggtttgttggggcgtgtgtatgtgtatttggggggactgaagggtacgtggggcgaaacaaaaccggccatggcagcagcggaggaggaggacgggggccccgaagggccaaatcgcgagcggggcggggcgggcgcgaccttcgaatgtaatatatgtttggagactgctcgggaagctgtggtcagtgtgtgtggccacctgtactgttggccatgtcttcatcagtggctggagacacggccagaacggcaagagtgtccagtatgtaaagctgggatcagcagagagaaggttgtcccgctttatgggcgagggagccagaagccccaggatcccagattaaaaactccaccccgcccccagggccagagaccagctccggagagcagagggggattccagccatttggtgataccgggggcttccacttctcatttggtgttggtgcttttccctttggctttttcaccaccgtcttcaatgcccatgagcctttccgccggggtacaggtgtggatctgggacagggtcacccagcctccagctggcaggattccctcttcctgtttctcgccatcttcttctttttttggctgctcagtatttgagctatgtctgcttcctgcccacctccagccagagaagaatcagtattgaggggggaaggaggatggattgagagaatgtctttctcctctcctaagtctttgctttccctgatttcttgatttgatcttcaaaggtgggcaaagttccctctgactcttcccccactccccatcttactgatttaatttaatttttcactccccagagtctaatatggattctgactcttaagtgcttccgccccctcactacctcctttaatacaaattcaataaaaaaggtgaaatata

SEQ ID NO: 416436 - DNA, 930 bp, Homo sapiens
  misc_feature (2)..(2): n is a, c, g, or t
  misc_feature (54)..(54): n is a, c, g, or t
  misc_feature (61)..(61): n is a, c, g, or t
antgtggtgaaacaggtgaaaacccttctgtaactaaaaaatacaaaaaactanccccagntgtggtggcaacaaggccctagtttatttatttatttaaaagaacggggtttccactctgtcaccccaggctgccaggcagtggcacaatcatggctcactgcaaacctcaaactccctgggttcgagcgatcctcttgcctcagcctcccaaagcacagtgacagcaagcctcactctacatcttcagtgctggacgtcatccagtgtcatggcatcatgtgatttttagggtactattcatgtgtgttcagttatgtaaacttgtttctcagttgtatcaataggcgtaaataagttctcattgttgatgttattgaagtgtatccataagtatgtatggtcattcctctttttttttttaaggatgatacatatatttatttcttaaaaatttcaggggacgtcccagtgttagccacttcttgtcccttctgtgggctacatccagttgtaattgttcagtacaacacatcaggtgtttgaaatgcctcaaatgtcaagaaacactaacttatctctggcataccgtactttttaaagcagaagtattttctgtaatggttactacagagtgtttactggttaatttttagttaaccagaagcatacattccatagctattccagttaactgaggtttatatccataaagacattaccagagatagaaaaatttcccttttcttcagctagagaccccaggcaccaacacaccctcaccaccttcttgaaaatataaagtgatgggacagggtgcggtggctcaagtctgtaatcctagtgctttgggaggctgaggcagatggatcacttgagaccaggagtttgagaccagtgtggtgaacatggtgaaacccttctgtacta

SEQ ID NO: 416437 - DNA, 1182 bp, Homo sapiens
tcctaattcttggctttagttctgttttcttcaactatagggagcgagtcaagtcatcccacctctgtgagacttgcttgattatttgcaggcatctatgcatgactccttccgtctttcattgtcttgactgcacagccttagtacctccagatccccacccacctattactttctcaggagttttgaactttctcactaacttttttaatgtggatctaggattgaaaagaatcgtgagcttaggaagcgttacagatacaaagactacaaattcaggtctcacttgtcaaatatcagaaaggttatttctgacagtcctccttccccaaatctaaatgtttccctcttttagcaatctttccctccctcataactttagcatggtgtatggtgtgtgcgtagtcatacattagtgtgatttttgtctgttttgaacactatactgtgaagtccacgaggtagaggcacagtgacagcaagcctcactctacatcttcagtgctggacgtcatccagtgtcatggcatcatgtgatttttagggtactattcatgtgtgttcagttatgtaaacttgtttctcagttgtatcaataggcgtaaataagttctcattgttgatgttattgaagtgtatccataagtatgtatggtcattcctctttttttttttaaggatgatacatatatttatttcttaaaaatttcaggggacgtcccagtgttagccacttcttgtcccttctgtgggctacatccagttgtaattgttcagtacaacacatcaggtgtttgaaatgcctcaaatgtcaagaaacactaacttatctctggcataccgtactttttaaagcagaagtattttctgtaatggttactacagagtgtttactggttaatttttagttaaccagaagcatacattccatagctattccagttaactgaggtttatatccataaagacattaccagagatagaaaaatttcccttttcttcagctagagaccccaggcaccaacacaccctcaccaccttcttgaaaatataaagtgatgggacagggtgcggtggctcaagtctgtaatcctagtgctttgggaggctgaggcagatggatcacttgagaccaggagtttgagaccagtgtggtgaacatggtgaaacccttctgtacta

SEQ ID NO: 416438 - DNA, 512 bp, Homo sapiens
acttccttgttcatctgttcattcattcattcttctatgcattggttagttcatggaatatctcactctttcattcattcatgtccttctgcaatgattcattcactgctttgttcatctgttcattcactcattcttctatgcattgatgaaatcactcattcagtgatttattcatctatactcatgcttcaatgcattgatttactcatttcctcatgcatttattcattcatctatgcattggttaaatcactggccaactcactaactcattcattcattcacacttttctgcaatgatttgttcacttgttcactcccttgcttatctgttcattcactcattcttcaatacattgaccaagccattcactgacatttattcagctacatttattctttcatgcattggtttctggatttatttggtcattcatttatttattttgcaaaattaatgtatttttaattgacaaataaaaactgtatatattttcatgtgcaacata

SEQ ID NO: 416439 - DNA, 438 bp, Homo sapiens
ccttttcacgtaatcacagtataaactgatttcttggctccaaatatgatgatagttttttaaaagagcaagaagcaagtatgctccctatatgtcatcatatacattttggaaacttcagagtcttaaaaatcattctgaccaggtgtggtggctcacacctgtaatccaatcacttctgaaggccaaagctggtagactgcttgagtccaggagtttaagaccggcctagtcaacatggcaaaaacccatctctacaaaaaaaaatgtataaattagctgggcgtggtggcatgttatctgtagttccagctacgtgggaggctgaggtgggaggaatacctgagcctggagaggtcgggacctcagtaagccgtgactgcaccactgcactccagcctaggtggcagagtgagaccctgtctcagaaaaaaaaaa

SEQ ID NO: 416440 - DNA, 2121 bp, Homo sapiens
  misc_feature (1)..(2): n is a, c, g, or t
nnaaaaggctcttgcaggaagcattgcttgttaggagccatcctgtgctttcaggtgtcacagattagcatggggttggagggtgggagacagcatcctgaagagcaggggtaggtgtggctttgcctggggctgtggcagagaggagagacatgcagttatcaaaagagtcagctgcactgtctttttagctttgccctgtggacactggaactcagctatttggagtttccaacatctctcacatcaagtccaaggagaacctttcccttagtttcctcagctgcagaatgggctgctgacttctcagggactttgagggaataactttcatttcattcacccagcagtgccctcatgtttactgttttcaatgagtaacagttgtctccattagtttgtgtttgttgttttgtaattctgcctttttttttcctctctctctatccctactccaaacaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatgaatgcacatatcatataccatgacttctgaagactataaatgaattccacaatcagtgcttcactgagaaccaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatgattttacctatacttggtaatgctttgttttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtagtccttaaatttgaatccgtcagcacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaa

SEQ ID NO: 416441 - DNA, 1995 bp, Homo sapiens
atttttttgtggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatgaatgcacatatcatataccatgacttctgaagactataaatgaattccacaatcagtgcttcactgagaaccaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatgattttacctatacttggtaatgctttgttttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtagtccttaaatttgaatccgtcagcacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaa

SEQ ID NO: 416442 - DNA, 1451 bp, Homo sapiens
atttttttgtggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtagtccttaaatttgaatccgtcagcacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaa

SEQ ID NO: 416443 - DNA, 959 bp, Homo sapiens
  misc_feature (41)..(41): n is a, c, g, or t
aatactacctcacacgtcgtataagtatttactcgaactcnccatcgctgtcactatagtatttcaatcgtatagattttatagcgccaaccaaagtaatttttcaacaaatgtgagtttggaaagaaactggactggaaatgcaactctgattcctggttcaattttaagttttgagaccaccacactgtggcccatcaccaccatcaactatatcacagtagcattcatcttttctaagggaaagccatttcgaaaacccatctatacaaactatatattttcatttctgctgctagctgccttgggcctcacaattttcattctgttttctgactttcaagttatataccgtggaatggagttgatcccaaccataacatcgtggagggttttaattttggtggtagccctcacccaattctgtgtggctttctttgcagaggattccatccttcaaaatcatgaactctggctgttgatcaaaagagaatttggattctactctaaaagtcaatataggacttggcaaaagaagctagcagaagactcaacctggcctcccataaacaggacagattattcaggtgatggcaaaaatggattctacatcaacggaggctatgaaagccatgaacagattccaaaaagaaaactcaaattgggaggccaacccacagaacagcatttctgggccaggctgtaatcagaattgtcgtcgtacatgctcaacagcattgcttttttccccaaaattaacacattgtggagaagtgatgatactctccccttacctttcctctctccattcaagcattcaaagtatattttcaatgaattaaaccttgcagcaagggaccttagataggcttattctgactgtatgctttaccaatgagagaaaaaaatgcatttcctgtatcatccttttcaataaactgtattcattttgcatagca

SEQ ID NO: 416444 - DNA, 247 bp, Homo sapiens
agtttatgaatttgtgtcgggccacacattcaaagccatctttgggctgcatgcggcctgcgggtcgtgggttggacaagcttgaattatataaagaactcttatcattcaacaataacaatatcaataatgcaattgaaaaatgaacaaaggatccaaatagaactttctctagcaaagatatacagatggtcagtagacagatgagaaagcgctcaacatcattacccatgagggaaataaaaat

SEQ ID NO: 416445 - DNA, 5575 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacaatcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattgagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaatttta

SEQ ID NO: 416446 - DNA, 3738 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccaggtaacttctgatctcataaagaacacactcaaaggctacccacatcaccatttgctgcaaaagaacagaaatcctttacaatgctctgtagccacattatttggtagaccaaagtaacaaggcccagacacatgttattcccatggtttcaaagcctctttggcctttagcggttttccctcagcctgcccacaatcccactccttattagaactttcctactccatttttccccccctttctctttaaaaacagccttgtagcattccataaaggtttcttataaatgataaatactgtaatgttggggacaga

SEQ ID NO: 416447 - DNA, 1279 bp, Homo sapiens
gccacaatcagccctaggatagtttacttattacttacgataaggatttttaaaggtaccatgaaaaattatgaaagacttttatatgggcattaaaaattacagggtgtcctgtctagggcacccttccaggctatctctgactttgtcttgaagctgttttacaaccctgtaagttgtagaaaactgacagtaatacaaatggtttttttttttttccagagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaattttaaattgtatcccaattatgcttttaccttcttaaaaatatcttttaacaaaggcttcagtgcttcagataatttttaaaaacagaaaaacaacaaaatcagagaagaaaaataggagagaactgagctaagcttggcacgaggagacatgcttgctcacatgacttctcaaccaagaccaaagggctaagagaatcctttccctttgcttccaaaaccagatatttcacaaggaaacaaaatgcactaaaaatatctcatgcttgatacttggggaaacagcagtaaatcttaagctttaaggatttactggtataacctttatgaaaactcaaaccttcaggttcatcaaagacaacatgttgggggtgattgttttattacaaaaagatccaattaaaggtttacctttaaggagctgtcagaatgcattttcaacagacttgtagaacctgtaatttgagggtcctgtacagaaagagtcccctgtaagaagcaggattctcaccatctgcacacaggccctcattctatcttggcctctaggctgcaagcagaagcacaggctttctacaataaaacacttggaaagctccgagcccatggcaatactggcagtgaaaactgaagaagtggccagcacatcactgtcccctgcttcgccccaccaggccacgtctaccacatcctgtccctatctccccacttctcatatatatacaaaacctccagggcagccaggtgcgatggggctcatgcctgtaatcccagcactttgggaggccaaggcgggcagatcacttgaggtcaggagttcaagaccaacctggccaacatggtgaaaccacgtctctac

SEQ ID NO: 416448 - DNA, 585 bp, Homo sapiens
accaaaaggagcacaaggtgaagagtatgtgtgtgaatgggcatcggagggcacagggaagatgtcccagcaaaaggaacatgagcatccatgcaagggagtgtggctggagaggcagggtgggcatggaggtggcctggaagccactctgtggaatgcacagatgtacattttaacctttgggcagacaggagccacccaagactacgatctatccctgtactcttctcggagtctgaaaaggttggcaaagtacaatcacaagatttattttcttaaacaggttaatggatgagtatgtgatgtgtgtgcagtgtgaattcggggtcttttgagaaaagacccaccatattcacaccaaaggaagcagcatcaaaggctgctcctcggcctccttgggtgttggcatgtggatgatgcctgggcttgcccagagcaggcacaggtcctacaacaaccctcgccacctcctgcctcccctgcagaaaaatgccatatacacgtctactacttagctctcaggagatcagcccctgacacaccaaaaaccaaaccaaaacaaaaatacactagtcaattaagtgc

SEQ ID NO: 416449 - DNA, 446 bp, Homo sapiens
accaaaaggagcacaaggtgaagagtatgtgtgtgaatgggcatcggagggcacagggaagatgtcccagcaaaaggaacatgagcatccatgcaagggagtgtggctggagaggcagggtgggcatggaggtggcctggaagccactctgtggaatgcacagatgtacattttaacctttgggcagacaggagccacccaagactacgatctatccctgtactcttctcggagtctgaaaagagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaatttta

SEQ ID NO: 416450 - DNA, 425 bp, Homo sapiens
gccacaatcagccctaggatagtttacttattacttacgataaggatttttaaaggtaccatgaaaaattatgaaagacttttatatgggcattaaaaattacagggtgtcctgtctagggcacccttccaggctatctctgactttgtcttgaagctgttttacaaccctgtaagttgtagaaaactgacagtaatacaaatggtttttttttttttccagagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaatttta

SEQ ID NO: 416451 - DNA, 5521 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttctgaccacaatcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattgagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaatttta

SEQ ID NO: 416452 - DNA, 6429 bp, Homo sapiens
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacaatcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctactgaagtcaactggggaagagagagaagcaccactcctccctcacagcacagcaaggccaccactaggagggggtctcaggttggtcctcccaaaccttgtccaaagactggagttattagttggctgactcagccacataatgggcccaagaaatgccagcgtcctagcagttcccttggttctgggtcagctgaaagagcttggctcttttttaggaactttggtgcctgaacattaagagtagatcactgctttattcttgagctgttcaccctccatgaagctctcaagtcctgcatcctgaggatccagatggatgacaaggacacaggactgccattgagaaatgaagatgaactgtgtcacagatgcagtggattactgactgcccttgtaatagtccattttgcatctgttggtaattcattgaggcactcttggttttctatgagtttgtattttttgaattcaagaattgtaacatcactgttagatccctccttatttaatgagagaaataaaatatttgacacgagaaaattttaaattgtatcccaattatgcttttaccttcttaaaaatatcttttaacaaaggcttcagtgcttcagataatttttaaaaacagaaaaacaacaaaatcagagaagaaaaataggagagaactgagctaagcttggcacgaggagacatgcttgctcacatgacttctcaaccaagaccaaagggctaagagaatcctttccctttgcttccaaaaccagatatttcacaaggaaacaaaatgcactaaaaatatctcatgcttgatacttggggaaacagcagtaaatcttaagctttaaggatttactggtataacctttatgaaaactcaaaccttcaggttcatcaaagacaacatgttgggggtgattgttttattacaaaaagatccaattaaaggtttacctttaaggagctgtcagaatgcattttcaacagacttgtagaacctgtaatttgagggtcctgtacagaaagagtcccctgtaagaagcaggattctcaccatctgcacacaggccctcattctatcttggcctctaggctgcaagcagaagcacaggctttctacaataaaacacttggaaagctccgagcccatggcaatactggcagtgaaaactgaagaagtggccagcacatcactgtcccctgcttcgccccaccaggccacgtctaccacatcctgtccctatctccccacttctcatatatatacaaaacctccagggcagccaggtgcgatggggctcatgcctgtaatcccagcactttgggaggccaaggcgggcagatcacttgaggtcaggagttcaagaccaacctggccaacatggtgaaaccacgtctctac

SEQ ID NO: 416453 - DNA, 5088 bp, Homo sapiens
  misc_feature (5045)..(5045): n is a, c, g, or t
  misc_feature (5054)..(5054): n is a, c, g, or t
aggcatgagcccttgggcccagccggctgtttaatgttcttaaatagcacaagggacttctatgaactttcctagatgaaatatttattaactactaggtaaaacacttgtttgatactgcaaagggttatttctgaaacttaaacctcatgattggccaaccaagaactttttctccacagcatgctttaataatgaaatgcggattaagagtccaatattataaaacatttccacaaaagaaagaatccatctgattctcaactctgaatgcacatttgaattccctcggggagcttttaaaagtctaatgccccagtgtaccccccccagttaattaattaaataattctctggggatgagaactgactgacagcaacacttaagcttcgagactgcagtgtgcagccgaggcccactcctccagcgtcaccacctcgtctttatctgccactgtgtctcctcattgcccacagctttagcaacagcaaaagtagaattcaaaccttggtaaacaaggcttaaattattactgttcatgaccttaattaattgaaaatgattactggtgaccacagcactccatgctcttccttatggaaaaagggttgcctagaagatttaggcaatactgggagttcttatttgaagtcacagaaaggagaaacttttctcaagccgtttttattacacttagtgtattaagacaagtacaaaataaccttgtaattaagatactgtatcagtcaaaaaagaagtcactattgtatgaagagatttacaaatgactaaaatatacaggctgtgacagaattaacagtttgaaagagggttgcttttttcttttagaaatgctaaattttcttaacaagacaaaaatacagtgctctaaatatgcattaccatgaaaacgttaaagaaaagcagtcttaacacttaactactattaacagcctttgccaacacatgcctgcctactccctttcctaactttaaagaactgtttcctctaaggaatactagtgcagcataacccttaaataatttcatttatttttaaagttacaacctacagagaaattaacatcttgtcaatctaataacagtggcaaccattcttcacatgcacttctcttagaataaatccccttggctggcaggataaggcttatgctgtagaaccttctcccccacagccacaaatccccttctataagtccctcctaccctcatccccccgcatccccactggcattcacctttcccaccccaaaaagtgcagctcatggtagccttctagaaaatggttttaatgggtatcccagcatacacgcttttttaaaagccccctctgaacaccagaggtggtgaaaatgaattgtgttcttggatttttttttttttaagcctccactgggtcaaaaatatgtgctcttaatacttgagtttttgctttgtgtgtgggttttctttctttttcatttagatatcgtgggataaagtggagaggacatctccattttcccatacaaactgagggtgagaagagaaagagaagcaagctgttgcccccactttggcctggcttcccagccatcttcccagctctggttctttcataggaactagttattgcttccacaatgccgttatacggaatgttccacaaaggctgtgaacctagtcacagtctacccacaacaagaactctgctctgaaaaaccagcccaagagctcttacccagaagaacaatctttagccctcaaggtcactgaaacttcattagagcagtttagagtagacgtgtaagatttggcatatattaaatgattattggcacaatgttctccagttccatgtataaatgttgatatgcacatcggccagggcccaggatgaatcagccaatctgcaccatttttatgtcagcaataattccatctcttccctttgagcactgtagggagagctgcttcatccggttctccaaggcctggccctcaggggaggtgctgctttggctcttactgctgccaccactgccactgctactgctgaggccccggttgttgttggctttgtcacttgttttattctctgccccttctgccctgtctcctatagaaatacaaggattatcaaaagtgagtattgacaattctgccctgtctcctatagaaatacaaagattatcaaaagtgagtattgacaattctaagtcacttgagctcaaaccagtcagctaactcagccctgtagaagtcccactgttacctaccgtgcctatcagagaggttctcagtacataatcatttactgcttttattccttgtgatgttttatatattccttagctatagagatgaaatttgccatattcactttattgctgagaaacaaacctctctactatgtgcttgccaaggagactgttctgatgtgagacataggacctaagctctactttatagaagctgagtggagccaggagcccccccagaacagcacttggaaacaacctcagtgatcaatactgacagcacaaccacagagacctggtaatgcagcatgggggccctgagacctggcagaggtatggaatggcacaacagtcaggctacagaggcagtgtggcatctgggacggggtgagaaggctgctactcacctcgttctacttcacattcaggggaggaggccccgctgcattcacttcgagggcccaacactgggaacatcatcccaaactctgacagggacacagggctgggcagatccaggctgccaggcctcacaaccgcagggaactggtcaggcatctcagacgggcttgttggtcctgaactaaagctggacacggactgggtttccgagtcatcttcagacacaaagttgctacagctgtcatcttcaaaggcctccgaggccactaagttgagagagaacaccagtcacatgggttctgtcacctcctcaaacaccacaagtgcttgctgctggcaggcagctagacacagcatgggggactaaagagtctctacctctgtgagtgcctaatgaaggaatgtgacttcccaagcctgaatgaccagcctctaaagcagctggaagggaagcagctggcagcaggatcccatggatattaagcgcccttccaataaccttataaccctgccaagaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccagaatcctgactttgaggaacacttagtaccttcttaatgaacacagtgttccataaaacatgggaacccaccagaaatagccctcaggcctgcccaactctgagacctttcactgatggccagagaaagtgaggaccttgggaaacaaatcacacagtctgatatctccccacatacccagtggagcccctgacttaccagaaatggcatcaggctcaggtttgctccctggcagatcctccacagatgtgctgctgccctcagcaccaacaccgcatccccgaggccccatggcactggagcgccgccgctcgtggatctcatctgagatcatctccaggttcttcagggccatcttgtactcgccttttgccagggtcagtttggcctgcaggtcatccacagtctttttcagttgctgatcaagagaacaggagactaagtgaagactaccctgctagccttaagatgctttctgaatgacaggttcaagtacattttctgcccatcattctacttcaaggaattttccaagacatgactgaagacctaattaccattgtaactgctattcattcaccagacaaaatcagccaccaccatccccagatcccatccaggtgacaacctctaatatccaaaaactctcactggtggaacaaaccccatcagggaagcaaaaatgggcatcagacacaccaaagtcccacagtctagacatctggttcccagtacagtggttctcaaagttgagcttgcatcaaaatccccttgggtgttaagactcagctcactagactccaacctcagagtttctaattcagtcggtctagagtgggacctggtctatcaggtctccaggtgatgctgatgctgctggtcctaagagcatgctgtgagaaccactggcctagtacaacagagaaggtgactgaatggcagttacagaggttcagagaccactgaagacccaaccgagacaattttgaggtctgaaaactcagtaaagcctgtctctccactttccccttatagcaagtggcccatgtgatactctgctaccccagaaaagtgaagctttgagtgcagaaaaatctcatcagtgacgaagcccaaagctacacatacctcgagctgcacatagtactttgccttgagttcaaaataaggcctgcagaagacaggaaggaaagccatcagagtaatataatacagtgaccacaatcaactccacaagatgaacaagaggcatcagctaccactggccaggtcgtccttccaatatttagtaaactcttaacaaggccgtgacatgtcagtgatgctcctagctctggagactgacagacaccagatggaacgactgggctcacccagggctatattaacaggaggcccatctcaagacacggggaacccacacacacatatcttggggactctgcaacttagctcatgttcctcctctgtgggaaggctgttcagagcctcacaggttatacccagcagtaagggtggcctggatctgctctcctaatgaagttggctccccagggatgaagagcagctgaggctggagaaggggctgcttaaacctcctcctctacctaatcgagggagagnacactgganaatggctttgagatcctctagaacactacacaaa

SEQ ID NO: 416454 - DNA, 732 bp, Homo sapiens
gaaatcagtgtcaccagacaccacctaaaaatggaagattaattcagccacaaattaggacctttactccacctcagtcccccaaatacatcctcatgtgcacaggaagaggttctagtcctctgtaacatatcccaaacaaagccagctggactcaggcttctttcttagggcaatagaagcaagagctgctagaagaaacaggccagcatggaacatctgttgggacctttgttatctccaggtaacttctgatctcataaagaacacactcaaaggctacccacatcaccatttgctgcaaaagaacagaaatcctttacaatgctctgtagccacattatttggtagaccaaagtaacaaggcccagacacatgttattcccatggtttcaaagcctctttggcctttagcggttttccctcagcctgcccacaatcccactccttattagaactttcctactccatttttccccccctttctctttaaaaacagccttgtagcattccataaaggtttcttataaatgataaatactgtaatgttggggacagaaaatgggctcagacctgaattgaatccctaactccactacttgctgtgtgaccttggtcaagttactttacctctgtaagcttcatgatcctctccatgcagggtttgagatgatgtatatattaaagtacctcatacatagtagttgttcaaatgatagtttccttttcctt

SEQ ID NO: 416455 - DNA, 546 bp, Homo sapiens
ggaaatttgagcctgggtttatctgtctccagatcagtggggtgaggggagtttctcccaggcccaggcaggaagggggtgcattgtctgtagaaaatgttttaggaaactaatctttggccaggtgggtttgttttttctaatcacttgcactggcaatcctaaacaatgccagggataaattactcttccctgcagggacctgcagggacggacactctcgctgcctgcgccctggtaaaccactgcaccatcttaaccactgtgttggttttggagcagatggaaagtggctccataatctaaatgaagcaagacagccttgaactttgatttcctacatatttccttaaatggccttttttgagagatttgggtttttctcaggccttctcttcctctttccttaattcctgcttgcttttctcacctctctgcataggtcagatttgttgtttttttcactaataaattgtattttcaattaattcaattagttgaatattcatgcttattataaaaaacaaaattcaggaaagtaataaa

SEQ ID NO: 416456 - DNA, 1316 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggctgtcacgaccaccacccagaggcccagcagcatgactaccacctggaggctcagtagcacaaccaccacaaccggcctcagggtcacacagggcaaacgacgctcagactcttggcacataagtctggagactgctgtgggggtggcagtggctgtcactgtgctcggaatcatgattttgggactgatctgcctcctcaggtggaggagaaggaaaggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaagat

SEQ ID NO: 416457 - DNA, 291 bp, Homo sapiens
gtccctgcctgcttctgtctcaagaaggctgatgtcacttcctctgatgaaatcctgtcttcccccacggcccctcaactgatgccacctcaccctggagagggtgggcagagcctcctacggagggagccctgtgcaccaccaaagctccctgctccagtgaccacccccgggcaaaggccggcagatccccgttagagatgggcccaggactgtgtgtggggtgggtgttgctctgagccttcactttcttctgtgtccaaggaagcttctggatcagccaagggctca

SEQ ID NO: 416458 - DNA, 1097 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaagat

SEQ ID NO: 416459 - DNA, 1403 bp, Homo sapiens
gtccctgcctgcttctgtctcaagaaggctgatgtcacttcctctgatgaaatcctgtcttcccccacggcccctcaactgatgccacctcaccctggagagggtgggcagagcctcctacggagggagccctgtgcaccaccaaagctccctgctccagtgaccacccccgggcaaaggccggcagatccccgttagagatgggcccaggactgtgtgtggggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggctgtcacgaccaccacccagaggcccagcagcatgactaccacctggaggctcagtagcacaaccaccacaaccggcctcagggtcacacagggcaaacgacgctcagactcttggcacataagtctggagactgctgtgggggtggcagtggctgtcactgtgctcggaatcatgattttgggactgatctgcctcctcaggtggaggagaaggaaaggtcagcagcggactaaagccacaaccccagccagggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaagat

SEQ ID NO: 416460 - DNA, 1063 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggggaacccttccaaaacacagaggagccatatgagaatatcaggaatgaaggacaaaatacagatcccaagctaaatcccaaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaagat

SEQ ID NO: 416461 - DNA, 2253 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggggacctgcagggacggacactctcgctgcctgcgccctggtaaaccactgcaccatcttaaccactgtgttggttttggagcagatggaaagtggctccataatctaaatgaagcaagacagccttgaactttgatttcctacatatttccttaaatggccttttttgagagatttgggtttttctcaggccttctcttcctctttccttaattcctgcttgcttttctcacctctctgcataggtcagatttgttgtttttttcactaataaattgtattttcaattaaaaaaaaaaaaaaaaaaaaaaaaaaaaaaaaaaaaaaaaaaaaaaaaaaaaaaaaaaaaaaaaaaaaaaaaaaaaaaaaagacagagaagagcaaaaaacaaatagagagagaggggggggcgcgcgcgcgcgccttgctctctctctccccgcggggggcgcagcccaggggggccccacaaattaagaaaaaaaaggagagggggcacaagagaggggggcttataaaaaaaagggggggggggggggagaaaaaacacagacgaggcgctatggggaggaacacgcagaggcctctggagctgccttatgtatgagcgactcgacaacttatctatctctctcgtgtcgtggcgacataagagtggggagtaccctatcaacgcaagtagcatacaatacacgccccggggggctgcacaacatacagattccacccatttcacacattataatagtttattataacaaacacacatatctctctacatattactatcatctagaaacaatgaaaataacactattcctcatataatgataataaaatatacactaatatacacacatacatcattaccaccacaggaatttttaatattactataactaaatcaataaacaccagaggaatacagcaaactgcacgagagagagtgagtctcggtggcagtaaaacggtagataagataagtatgagagagatagtcgcgagtcgcgatgagggacagcgacaggaagagagatcatgcagacgagaggtcaaggttgggcacctaggagatcggaagaggataagaaacgtcgatgaagaaaacaacagaacagcgacaacgacgcaacctcaagcacgaagcacatcacgtgaaagcaggaggggaacagaggagcgcgaattagccagcgacgatgcacggcacgacagcggcacggatgtgcgaggcgcagcagtaaggagctacactaagatagatacaacaacaatccgaaatgaggatacagactgctgaatgcgtcacaagccacgtaaatggtatacggaacacgagagtgagaagagaaggacggcggcgatgcgtacagagacattctcgtgctgcttcagggagcactacgagccacagagtgataagcagggtacctctagcgacgctgacgctgcggagcctaccacgttagcgatcacggtgcagcgctcgagaccacaggcgacgattacttctccagacctagacgctagcacgagcctctacgctgtggccagtacgcagctaaagacaagaggcgcgaagaaaag

SEQ ID NO: 416462 - DNA, 1785 bp, Homo sapiens
ggaaatttgagcctgggtttatctgtctccagatcagtggggtgaggggagtttctcccaggcccaggcaggaagggggtgcattgtctgtagaaaatgttttaggaaactaatctttggccaggtgggtttgttttttctaatcacttgcactggcaatcctaaacaatgccagggataaattactcttccctgcagggacctgcagggacggacactctcgctgcctgcgccctggtaaaccactgcaccatcttaaccactgtgttggttttggagcagatggaaagtggctccataatctaaatgaagcaagacagccttgaactttgatttcctacatatttccttaaatggccttttttgagagatttgggtttttctcaggccttctcttcctctttccttaattcctgcttgcttttctcacctctctgcataggtcagatttgttgtttttttcactaataaattgtattttcaattaaaaaaaaaaaaaaaaaaaaaaaaaaaaaaaaaaaaaaaaaaaaaaaaaaaaaaaaaaaaaaaaaaaaaaaaaaaaaaaaagacagagaagagcaaaaaacaaatagagagagaggggggggcgcgcgcgcgcgccttgctctctctctccccgcggggggcgcagcccaggggggccccacaaattaagaaaaaaaaggagagggggcacaagagaggggggcttataaaaaaaagggggggggggggggagaaaaaacacagacgaggcgctatggggaggaacacgcagaggcctctggagctgccttatgtatgagcgactcgacaacttatctatctctctcgtgtcgtggcgacataagagtggggagtaccctatcaacgcaagtagcatacaatacacgccccggggggctgcacaacatacagattccacccatttcacacattataatagtttattataacaaacacacatatctctctacatattactatcatctagaaacaatgaaaataacactattcctcatataatgataataaaatatacactaatatacacacatacatcattaccaccacaggaatttttaatattactataactaaatcaataaacaccagaggaatacagcaaactgcacgagagagagtgagtctcggtggcagtaaaacggtagataagataagtatgagagagatagtcgcgagtcgcgatgagggacagcgacaggaagagagatcatgcagacgagaggtcaaggttgggcacctaggagatcggaagaggataagaaacgtcgatgaagaaaacaacagaacagcgacaacgacgcaacctcaagcacgaagcacatcacgtgaaagcaggaggggaacagaggagcgcgaattagccagcgacgatgcacggcacgacagcggcacggatgtgcgaggcgcagcagtaaggagctacactaagatagatacaacaacaatccgaaatgaggatacagactgctgaatgcgtcacaagccacgtaaatggtatacggaacacgagagtgagaagagaaggacggcggcgatgcgtacagagacattctcgtgctgcttcagggagcactacgagccacagagtgataagcagggtacctctagcgacgctgacgctgcggagcctaccacgttagcgatcacggtgcagcgctcgagaccacaggcgacgattacttctccagacctagacgctagcacgagcctctacgctgtggccagtacgcagctaaagacaagaggcgcgaagaaaag

SEQ ID NO: 416463 - DNA, 1014 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccaggggacctgcagggacggacactctcgctgcctgcgccctggtaaaccactgcaccatcttaaccactgtgttggttttggagcagatggaaagtggctccataatctaaatgaagcaagacagccttgaactttgatttcctacatatttccttaaatggccttttttgagagatttgggtttttctcaggccttctcttcctctttccttaattcctgcttgcttttctcacctctctgcataggtcagatttgttgtttttttcactaataaattgtattttcaattaattcaattagttgaatattcatgcttattataaaaaacaaaattcaggaaagtaataaa

SEQ ID NO: 416464 - DNA, 834 bp, Homo sapiens
tgaggagtcctgcgatcatcggcacggaacccttccaaaacacagaggagccatatgagaatatcaggaatgaaggtgagtccttaccaccatccttccccagtttctacccctggcacttcctgtttccccaaataccccctacctgggtccgtgcccctgtcagtattttcttctttccattccttgccccttgccctcacgtgaccctggccctgacctagcagataacctcactcctagagccccctgcccatctctctcccctggctgtcacgccacctgaccttggcacaccttgctttttattcttaggacaaaatacagatcccaagctaaatcccaaggtaagcaatcagaccagggcctgaaggaattaaagagaagcctggagaaggtggggtggaagggagaaggggagtgtggtgtgggcaggagagtcaaactgtaggcttgccgctaagatgggaacagctccgtctccactgtctaaccctttctctctgggttctcgcccaggatgacggcatcgtctatgcttcccttgccctctccagctccacctcacccagagcacctcccagccaccgtcccctcaagagcccccagaacgagaccctgtactctgtcttaaaggcctaaccaatggacagccctctcaagactgaatggtgaggccaggtacagtggcgcacacctgtaatcccagctactctgaagcctgaggcagaatcaagtgagcccaggagttcagggccagctttgataatggagcgagatgccatctctagttaaaaatatatattaacaataaagtaacaaatttaaaaagat

SEQ ID NO: 416465 - DNA, 931 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggttgaaaatattggccagacacagtggctcatgcctgcagtcctggctactcaggaagctgagacagaattgcttgaacccgggagtcagaggaggtttcagtgagccaagatcgcatcactgcactccagcctgagtgacagagcaaggcttcttaatttaaaaaaaaatttgtatgtagtgataatttattttggtatatggcataaacaactaaattgatctttatatgaaataatataatcagttgtcccaaccccattta

SEQ ID NO: 416466 - DNA, 843 bp, Homo sapiens
aataggggaaaataagccagatggataaaggaagtgctggtcaccctggaggtgcactggtttggggaaggctcctggcccccacagccctcttcggagcctgagcccggctctcctcactcacctcaacccccaggcggcccctccacagggcccctctcctgcctggacggctctgctggtctccccgtcccctggagaagaacaaggccatgggtcggcccctgctgctgcccctactgcccctgctgctgccgccagcatttctgcagcctagtggctccacaggatctggtccaagctacctttatggggtcactcaaccaaaacacctctcagcctccatgggtggctctgtggaaatccccttctccttctattacccctgggagttagccacagctcccgacgtgagaatatcctggagacggggccacttccacgggcagtccttctacagcacaaggccgccttccattcacaaggattatgtgaaccggctctttctgaactggacagagggtcagaagagcggcttcctcaggatctccaacctgcagaagcaggaccagtctgtgtatttctgccgagttgagctggacacacggagctcagggaggcagcagtggcagtccatcgaggggaccaaactctccatcacccagggtgagtccagctgccctggcacccgctttgcccaccgcagtgaggcttttatgatcactggtgacatcgtccccagcacctcagaccccacttcttctgacgacccctaagttctctctttggcccctaacacttcctcaggcctttgccacctctccccttttctcttccccttgt

SEQ ID NO: 416467 - DNA, 1442 bp, Homo sapiens
tttttttttttgttgtgtgtgttgtaagatcagatttatttggagaaaacaaaaaacccacaacccaaaggatgggattttacatcaagacatctcccaggtaataagtctacagattacaaatcattttcatagaagatatttttgtacaaattttacatgtattcaggagcgggacattaatcaatccctgtttctattttaataggggggacaaggtaggggagagggaaaaacagttttggatataactatttggaaggagagtagacatgaagagggcaaaccctagcttttcattatctacaatcaatagtttgtttttcttttttaaaaaagaaagaaaaaccctttcaatcttcaatactctttaaaagcccacttcttagctactggccaatccacaccaattatttaaattcacttggtacacacctttgtccactgggtaaattatattcattatgcccactgctgcagcacgcataaaccaacacccctgcatggctgaacagggcctaatctaggactgatgggagaagggcttgcaaaccaagatcaaggtgtttctccgctaatactgtctaccaagctgatccctacaaaaatgcatataaaagcaggcaagtttagctactgtgttgcaagagaaaccaggaccttgttaaatagttctctccattaccatttattctctcaagggaagcttaaaaaaaaaacaacaacaaaacaacacattggtctggccacctcatgaatccaacaagcattagtgtggcatttcagtggagaaggaaacttggggggaaaaatcccatcaaggttgtaagaaaggctcccaatttaactgtccctgtccctatttatccatcatccaagaccatccattattctagagcactctgatcaataaaaggggtccaagcatcaggagcaggcaaggagaaccaaaagacatcaagaaaccgatttgcttgagaaaagcagcgattcttcctttcagagttctccatggctcagaaaatgcccaagacatcatgtatgtgacttagatactgctttttgggaggttaagagtagcatgaagaacttaagatgatgataagagtctaaatttttagtttcaaggtttcaatagaatgtggatatattcaaaactttcaaaaaggacagtgtttagaaagggtaaaactaggacacagaaaacactgggaattaccacgacccccaagtgcttccggctccaggaaataaccattcatgtgtttgctggaggtcacacaattttcccctattacctggtgcaaaatgactcatcacttcccaaaagcttcttttcaaaccacgattttcccatttattttggtccaatgcagtcccattctttatggcctatagtctcactcccaactacccccctggggggttaaaaaaaaaaaagg

SEQ ID NO: 416468 - DNA, 1189 bp, Homo sapiens
tttttttttttgttgtgtgtgttgtaagatcagatttatttggagaaaacaaaaaacccacaacccaaaggatgggattttacatcaagacatctcccaggtaataagtctacagattacaaatcattttcatagaagatatttttgtacaaattttacatgtattcaggagcgggacattaatcaatccctgtttctattttaataggggggacaaggtaggggagagggaaaaacagttttggatataactatttggaaggagagtagacatgaagagggcaaaccctagcttttcattatctacaatcaatagtttgtttttcttttttaaaaaagaaagaaaaaccctttcaatcttcaatactctttaaaagcccacttcttagctactggccaatccacaccaattatttaaattcacttggtacacacctttgtccactgggtaaattatattcattatgcccactgctgcagcacgcataaaccaacacccctgcatggctgaacagggcctaatctaggactgatgggagaagggcttgcaaaccaagatcaaggtgtttctccgctaatactgtctaccaagctgatccctacaaaaatgcatataaaagcaggcaagtttagctactgtgttgcaagagaaaccaggaccttgttaaatagttctctccattaccatttattctctcaagggaagcttaaaaaaaaaacaacaacaaaacaacacattggtctggccacctcatgaatccaacaagcattagtgtggcatttcagtggagaaggaaacttggggggaaaaatcccatcaaggttgtaagaaaggctcccaatttaactgtccctgtccctatttatccatcatccaagaccatccattattctagagcactctgatcaataaaaggggtccaagcatcaggagcaggcaaggagaaccaaaagacatcaagaaaccgatttgcttgagaaaagcagcgattcttcctttcagagttctccatggctcagaaaatgcccaagacatcatgtatgtgacttagatactgctttttgggaggttaagagtagcatgaagaacttaagatgatgataagagtctaaatttttagtttcaaggtttcaatagaatgtggatatattcaaaactttcaggctgactgtgctgtcctgattgttg

SEQ ID NO: 416469 - DNA, 1458 bp, Homo sapiens
  misc_feature (123)..(123): n is a, c, g, or t
  misc_feature (163)..(163): n is a, c, g, or t
  misc_feature (168)..(168): n is a, c, g, or t
  misc_feature (170)..(170): n is a, c, g, or t
acgtacctacaaaacacaaaacgtgccacaactcacctttcctgcccctttctcttagcttcaactcttcttcccggactcccccttttttgactacccatttttgaacccaccccccagggnttccaccaactttgcagtaatctccaacactattcataanaaatntntttacatgtattcaggagcgggacattaatcaatccctgtttctattttaataggggggacaaggtaggggagagggaaaaacagttttggatataactatttggaaggagagtagacatgaagagggcaaaccctagcttttcattatctacaatcaatagtttgtttttcttttttaaaaaagaaagaaaaaccctttcaatcttcaatactctttaaaagcccacttcttagctactggccaatccacaccaattatttaaattcacttggtacacacctttgtccactgggtaaattatattcattatgcccactgctgcagcacgcataaaccaacacccctgcatggctgaacagggcctaatctaggactgatgggagaagggcttgcaaaccaagatcaaggtgtttctccgctaatactgtctaccaagctgatccctacaaaaatgcatataaaagcaggcaagtttagctactgtgttgcaagagaaaccaggaccttgttaaatagttctctccattaccatttattctctcaagggaagcttaaaaaaaaaacaacaacaaaacaacacattggtctggccacctcatgaatccaacaagcattagtgtggcatttcagtggagaaggaaacttggggggaaaaatcccatcaaggttgtaagaaaggctcccaatttaactgtccctgtccctatttatccatcatccaagaccatccattattctagagcactctgatcaataaaaggggtccaagcatcaggagcaggcaaggagaaccaaaagacatcaagaaaccgatttgcttgagaaaagcagcgattcttcctttcagagttctccatggctcagaaaatgcccaagacatcatgtatgtgacttagatactgctttttgggaggttaagagtagcatgaagaacttaagatgatgataagagtctaaatttttagtttcaaggtttcaatagaatgtggatatattcaaaactttcaaaaaggacagtgtttagaaagggtaaaactaggacacagaaaacactgggaattaccacgacccccaagtgcttccggctccaggaaataaccattcatgtgtttgctggaggtcacacaattttcccctattacctggtgcaaaatgactcatcacttcccaaaagcttcttttcaaaccacgattttcccatttattttggtccaatgcagtcccattctttatggcctatagtctcactcccaactacccccctggggggttaaaaaaaaaaaagg

SEQ ID NO: 416470 - DNA, 1619 bp, Homo sapiens
cggggacccactctgcccagccggaggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctattaaaatagaaactttacatgtattcaggagcgggacattaatcaatccctgtttctattttaataggggggacaaggtaggggagagggaaaaacagttttggatataactatttggaaggagagtagacatgaagagggcaaaccctagcttttcattatctacaatcaatagtttgtttttcttttttaaaaaagaaagaaaaaccctttcaatcttcaatactctttaaaagcccacttcttagctactggccaatccacaccaattatttaaattcacttggtacacacctttgtccactgggtaaattatattcattatgcccactgctgcagcacgcataaaccaacacccctgcatggctgaacagggcctaatctaggactgatgggagaagggcttgcaaaccaagatcaaggtgtttctccgctaatactgtctaccaagctgatccctacaaaaatgcatataaaagcaggcaagtttagctactgtgttgcaagagaaaccaggaccttgttaaatagttctctccattaccatttattctctcaagggaagcttaaaaaaaaaacaacaacaaaacaacacattggtctggccacctcatgaatccaacaagcattagtgtggcatttcagtggagaaggaaacttggggggaaaaatcccatcaaggttgtaagaaaggctcccaatttaactgtccctgtccctatttatccatcatccaagaccatccattattctagagcactctgatcaataaaaggggtccaagcatcaggagcaggcaaggagaaccaaaagacatcaagaaaccgatttgcttgagaaaagcagcgattcttcctttcagagttctccatggctcagaaaatgcccaagacatcatgtatgtgacttagatactgctttttgggaggttaagagtagcatgaagaacttaagatgatgataagagtctaaatttttagtttcaaggtttcaatagaatgtggatatattcaaaactttcaaaaaggacagtgtttagaaagggtaaaactaggacacagaaaacactgggaattaccacgacccccaagtgcttccggctccaggaaataaccattcatgtgtttgctggaggtcacacaattttcccctattacctggtgcaaaatgactcatcacttcccaaaagcttcttttcaaaccacgattttcccatttattttggtccaatgcagtcccattctttatggcctatagtctcactcccaactacccccctggggggttaaaaaaaaaaaagg

SEQ ID NO: 416471 - DNA, 630 bp, Homo sapiens
tttttttttttgttgtgtgtgttgtaagatcagatttatttggagaaaacaaaaaacccacaacccaaaggatgggattttacatcaagacatctcccaggtaataagtctacagattacaaatcattttcatagaagatatttttgtacaaattttacatgtattcaggagcgggacattaatcaatccctgtttctattttaataggggggacaaggtaggggagagggaaaaacagttttggatataactatttggaaggagagtagacatgaagagggcaaaccctagcttttcattatctacaatcaatagtttgtttttcttttttaaaaaagaaagaaaaaccctttcaatcttcaatactctttaaaagcccacttcttagctactggccaatccacaccaattatttaaattcacttggtacacacctttgtccactgggtaaattatattcattatgcccactgctgcagcacgcataaaccaacacccctgcatggctgaacagggcctaatctaggactgatgggagaagggcttgcaaaccaagatcaaggtgtttctccgctaatactgtctaccaagctgatgtcgacgcggccgcgaatttagtagtagtaggc

SEQ ID NO: 416472 - DNA, 3857 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacaagtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaatat

SEQ ID NO: 416473 - DNA, 3803 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacaagtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatctcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaatat

SEQ ID NO: 416474 - DNA, 3618 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacaagtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaacccaaaaaaaaaaatat

SEQ ID NO: 416475 - DNA, 1831 bp, Homo sapiens
atagaattacagaaccacaagggaccttagagaaataatgcacttattttgcaaatgagaaagctgaggcctagagagggaaatgagttacccaaaatcaaatagctagacctgggtctagactctttccataaattatatgtcaaatttctttggtataactttagttattaaaatctttttgaactcggaaggtgaaaaacttgcttcttcagtgaccaaatcatggaaaaatccctggaatcttcttgtttccagtttcaggcagtcctacattacagttcctttttgagtaaaaaatgcgtggccacagtccaaagttaatgtgtgtccaaaaggataagtggaccaaatagcaatttataattacatactaaactcagagccgcacagaggctgaaaacaaaaagcttgagtatatttggtttgatcatattaattgaaaaatttcagtctgcagcacacttgtcttcaaaaaatgttgatttgaaaagtactgtaaatctcagttttccacttcctttctagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttctttttcttgccttaatgcattggctagaacttttagtacaatgctggatcagcggatcgggtaccgagctc

SEQ ID NO: 416476 - DNA, 467 bp, Homo sapiens
  misc_feature (413)..(413): n is a, c, g, or t
  misc_feature (444)..(444): n is a, c, g, or t
  misc_feature (464)..(464): n is a, c, g, or t
gtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgccctccacgcccttcaggaggagcaggccagactcaagatgaggctgtgggacctgcagcagctgagaaaggagctcggggactcccccaaagacaaggtcccattttcagtgcccaagattccccctggtattccgaggacacacccagcaggacccggaagtgcctaagtctttagtttccaatttgcggatccactgccctctgcttgcgggctctnctctgatcacctttgatgaccccaaaggtangctcatggggagcctcatgngtg

SEQ ID NO: 416477 - DNA, 324 bp, Homo sapiens
aggtaaaataacttgtctgaagttacacagctaagaagtgttattgccaggatagagccccaggcccggctctcagccatgctgctgtctcagtgtagcttgatgtaggtggcttctccctgcccatctcttccccctgtgggtccctgcttggcccacctcacctgtcagccagtggattcaactctgcatcaggcccagcacagagaaggcaaagataaagccttctaaacaaagtaacatcagcaggaacgatccccttctttgcatttgggtcaagtagttcatgagatagagcagaaagagcatgggcttggctacctg

SEQ ID NO: 416478 - DNA, 3399 bp, Homo sapiens
  misc_feature (2441)..(2441): n is a, c, g, or t
gcctgggtgacagagcgagactgtctcaataataataatagtaataatcatgctgcctgtgtcccctgatgagacagcactggccgcaggtggccgctaacctctcgaaatagggatggcccgaattgagacatatgcaagtcaacactacaccgggtttcagaaacacatacgattttcaaaagaattaaaatatcgcatttagtttttctattgattgcatgttgaaatcttactttggatatattggattaaataaagtatatcattaaaatttttaagcttatgtgcctatgagaaacttccaaattacacagttggatggcgttatatttctcttggacagcagtggtctgaaagatgacaaaaatcacgatacgtttgaatcacgccatgtctttagggaaaagaagaaagaagagtttcctttcgtatcgcttaggggttcctcgcaagaaccatctgacagagaaaagccctggctcccgccccagtggcttctaattctggtccccgcgcccagaaagccgggaacgggcaagcctggaaaggcgttttgaaaggaaacaggatcccccgagtataggatgcgtttctgcctcacaaaagtcccttgggggtggggggacggcagcggctgaggcgcaggaaagaggagagcacacggggagtggcccttggaaccaggcgcgcaaaacctcagcccctaggctccatttccaggttcgcgggtgacctccccaagatggccgccgcctgggggcgggcctccacgctgcacgggtgttgattgggtgagacgactcaatggtgagcaatgattggttcacacggcgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagtaaacatggccttccaccttcagagaccatagccatcgtggagcacataaacgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgattttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaanatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttt

SEQ ID NO: 416479 - DNA, 3280 bp, Homo sapiens
  misc_feature (2322)..(2322): n is a, c, g, or t
gcctgggtgacagagcgagactgtctcaataataataatagtaataatcatgctgcctgtgtcccctgatgagacagcactggccgcaggtggccgctaacctctcgaaatagggatggcccgaattgagacatatgcaagtcaacactacaccgggtttcagaaacacatacgattttcaaaagaattaaaatatcgcatttagtttttctattgattgcatgttgaaatcttactttggatatattggattaaataaagtatatcattaaaatttttaagcttatgtgcctatgagaaacttccaaattacacagttggatggcgttatatttctcttggacagcagtggtctgaaagatgacaaaaatcacgatacgtttgaatcacgccatgtctttagggaaaagaagaaagaagagtttcctttcgtatcgcttaggggttcctcgcaagaaccatctgacagagaaaagccctggctcccgccccagtggcttctaattctggtccccgcgcccagaaagccgggaacgggcaagcctggaaaggcgttttgaaaggaaacaggatcccccgagtataggatgcgtttctgcctcacaaaagtcccttgggggtggggggacggcagcggctgaggcgcaggaaagaggagagcacacggggagtggcccttggaaccaggcgcgcaaaacctcagcccctaggctccatttccaggttcgcgggtgacctccccaagatggccgccgcctgggggcgggcctccacgctgcacgggtgttgattgggtgagacgactcaatggtgagcaatgattggttcacacggcgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagccgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagtaaacatggccttccaccttcagagaccatagccatcgtggagcacataaacgccaagtgtcctaacctggagtttgtggggctgatgaccataggaagctttgggcatgatcttagtcaaggaccaaatccagacttccagctgttattgtccctccgggaggagctgtgtaaaaagctgaacatccctgctgaccaggttgagctgagcatgggcatgtccgcggatttccagcatgcggttgaagtaggatctacaaatgtccgaataggaagcacgattttggagagcgggattactcaaagaaacccaccccggacaagtgcgcagcagacgtgaaggccccgctggaggtggcacaggagcactgagccagggaatactgagagcactaactatgcactaacctagattttcatttcgatattccctgtgtcccagcgcagtcctgctctcctgtgacctgtggagagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaanatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttt

SEQ ID NO: 416480 - DNA, 2968 bp, Homo sapiens
  misc_feature (2010)..(2010): n is a, c, g, or t
gcctgggtgacagagcgagactgtctcaataataataatagtaataatcatgctgcctgtgtcccctgatgagacagcactggccgcaggtggccgctaacctctcgaaatagggatggcccgaattgagacatatgcaagtcaacactacaccgggtttcagaaacacatacgattttcaaaagaattaaaatatcgcatttagtttttctattgattgcatgttgaaatcttactttggatatattggattaaataaagtatatcattaaaatttttaagcttatgtgcctatgagaaacttccaaattacacagttggatggcgttatatttctcttggacagcagtggtctgaaagatgacaaaaatcacgatacgtttgaatcacgccatgtctttagggaaaagaagaaagaagagtttcctttcgtatcgcttaggggttcctcgcaagaaccatctgacagagaaaagccctggctcccgccccagtggcttctaattctggtccccgcgcccagaaagccgggaacgggcaagcctggaaaggcgttttgaaaggaaacaggatcccccgagtataggatgcgtttctgcctcacaaaagtcccttgggggtggggggacggcagcggctgaggcgcaggaaagaggagagcacacggggagtggcccttggaaccaggcgcgcaaaacctcagcccctaggctccatttccaggttcgcgggtgacctccccaagatggccgccgcctgggggcgggcctccacgctgcacgggtgttgattgggtgagacgactcaatggtgagcaatgattggttcacacggcgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatggctgtccccaatctcttcatgctggaaacagtggattctgtgaagttggcagacaaagtgaacagttcctggcagagaaaaggttctcctgaaaggttaaaggttatggtccagattaacaccagcggagaagagagtaaacatggccttccaccttcagagaccatagccatcgtggagcactaatgatcacgtgtgttgatggaaaccatctgtgcttagtctctgacataggaagcttgcttcaggcaatggctttggattgagtttgagaaattcaaacatttctgcagaacagataccaaatcaatagctaggaatcatgttcaatattgaattctgcccaggagcatgaactgatccatgaatgccttttccaggttaaaatttggtcactgatgcctataatcgtggaagtcagagggattcccctttttcatctcattttaataggaaaattccttatggttaacatctccctacaaactcctactacgtcgtctaaattgctgctctggaataaggtgatttctgcccccagattcttccctagccggtagatacgtgaagatattcccaactgtggaatggcagtgtaggtagcttcaggaaatggctcaggttaattctcaaaacacaaattgttgctggccaggcatggtgactcatgcctgtaatcccagcaatttgggagacagaggcggaaggatcacctgagcctaggagttcaagaccagcctcagcaacagcaggagccccaccccccgtctctacaaaaanatttaaaaattaactgggcatggtggctgaggtggaagaatggaagaatcacttgagcccaggagtttgaggctgcagtgagctatgattgcaccactgtactcctgccttaaaaaaaaaaaaaaaatcccaatagtccatgaaggctttgatctcttgggaagttcttcatagatgctgtcacatttcttaaagcaaccttttaatatgcagataataccccccaacttttttagagacagcctgtctcttaaaaaaaaaattaatttggtagtgagagcttgtgtcactgccactctgttttatccctgaaattaaaggataacataaggaggacttgggcctttctgacatcatcctgaagagacaggactttgcgtttttcctctgggacctacagtgatgagaatttaatgattatctcctccactataatcctctttagggtgattttttaaatcaaaacccagtgaatctcattactcctaagaaacgaaagattccttcaaagccttttcaggcacatggtttcaacaaagcctggctttgacattccttgtcctgaggagcactttccaggcatagttacagcttccccactgtatttacaagccagaattgtgcaactcttctggatcattaataaagtagcaagatcctcaaaaaacccaaaaacaccattctctaatagtcatgacaaatggcttcagtatggcttgttttttattttccagatggctttttctcttattttttgaagccccagtctttgattttacaggtaactttcaaaacatcatgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttatttttt

SEQ ID NO: 416481 - DNA, 1466 bp, Homo sapiens
gcctgggtgacagagcgagactgtctcaataataataatagtaataatcatgctgcctgtgtcccctgatgagacagcactggccgcaggtggccgctaacctctcgaaatagggatggcccgaattgagacatatgcaagtcaacactacaccgggtttcagaaacacatacgattttcaaaagaattaaaatatcgcatttagtttttctattgattgcatgttgaaatcttactttggatatattggattaaataaagtatatcattaaaatttttaagcttatgtgcctatgagaaacttccaaattacacagttggatggcgttatatttctcttggacagcagtggtctgaaagatgacaaaaatcacgatacgtttgaatcacgccatgtctttagggaaaagaagaaagaagagtttcctttcgtatcgcttaggggttcctcgcaagaaccatctgacagagaaaagccctggctcccgccccagtggcttctaattctggtccccgcgcccagaaagccgggaacgggcaagcctggaaaggcgttttgaaaggaaacaggatcccccgagtataggatgcgtttctgcctcacaaaagtcccttgggggtggggggacggcagcggctgaggcgcaggaaagaggagagcacacggggagtggcccttggaaccaggcgcgcaaaacctcagcccctaggctccatttccaggttcgcgggtgacctccccaagatggccgccgcctgggggcgggcctccacgctgcacgggtgttgattgggtgagacgactcaatggtgagcaatgattggttcacacggcgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatgggaaagtctgagttcttaataaaaagagaaaacatcatgccaagaacagaatgaattcaccattttctgggttatatatacttggaaacctacccaacctcatgtttattattatttggtggtctttcagaaaaattataaagaattgtagcccataaatttttttaactagcaaaagagacatttctgttctttttcctttaaataaaaggctacagtaaataaaatacaataca

SEQ ID NO: 416482 - DNA, 1592 bp, Homo sapiens
gcctgggtgacagagcgagactgtctcaataataataatagtaataatcatgctgcctgtgtcccctgatgagacagcactggccgcaggtggccgctaacctctcgaaatagggatggcccgaattgagacatatgcaagtcaacactacaccgggtttcagaaacacatacgattttcaaaagaattaaaatatcgcatttagtttttctattgattgcatgttgaaatcttactttggatatattggattaaataaagtatatcattaaaatttttaagcttatgtgcctatgagaaacttccaaattacacagttggatggcgttatatttctcttggacagcagtggtctgaaagatgacaaaaatcacgatacgtttgaatcacgccatgtctttagggaaaagaagaaagaagagtttcctttcgtatcgcttaggggttcctcgcaagaaccatctgacagagaaaagccctggctcccgccccagtggcttctaattctggtccccgcgcccagaaagccgggaacgggcaagcctggaaaggcgttttgaaaggaaacaggatcccccgagtataggatgcgtttctgcctcacaaaagtcccttgggggtggggggacggcagcggctgaggcgcaggaaagaggagagcacacggggagtggcccttggaaccaggcgcgcaaaacctcagcccctaggctccatttccaggttcgcgggtgacctccccaagatggccgccgcctgggggcgggcctccacgctgcacgggtgttgattgggtgagacgactcaatggtgagcaatgattggttcacacggcgcaagctgggcggaaccggaagatggtgtgagccacgggctgccgggggcctggggctcggcgtcggtccccgggggatgtggagagctggcagcatgtcggccgagctgggagtcgggtgcgcattgcgggcggtgaacgagcgcgtgcagcaggctgtggcgcggcggccgcgggatctcccagccatccagccccggctagtggcggtcagcaaaaccaaacctgcagacatggtgatcgaggcctatggacatgggcagcgcacttttggcgagaactacgttcaggaactgctagaaaaagcatcaaatcccaaaattctgtctttgtgtcctgagatcaaatggcacttcattggccacctacagaaacaaaatgtcaacaaattgatgggtaagataaaattaaatatgaaaacaaaattgttctgtcattgtattgcttctactaccctttgtggaagagagagcaacttttagaatagccccaattcaccatttgtttttggaatttctttaggaaagtctgagttcttaataaaaagagaaaacatcatgccaagaacagaatgaattcaccattttctgggttatatatacttggaaacctacccaacctcatgtttattattatttggtggtctttcagaaaaattataaagaattgtagcccataaatttttttaactagcaaaagagacatttctgttctttttcctttaaataaaaggctacagtaaataaaatacaataca

SEQ ID NO: 416483 - DNA, 2141 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416484 - DNA, 1020 bp, Homo sapiens
  misc_feature (911)..(913): n is a, c, g, or t
  misc_feature (920)..(920): n is a, c, g, or t
aagttaggctaggtacgaggctggtgtctaatcggccgagggacctaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccccgggtttcccggggnnntgggccngcccgattttgggaagccccgtgggccctcaactcgccgtgggttcccacaggggggggccaggacagcacaaggccggcagaatcgcctaacgagtgag

SEQ ID NO: 416485 - DNA, 2331 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtgaggggccctgggggtccggtaggcatgggggtcatggaggggagaagccggcgtcctcctcccagccgactccctggcgccgcccacccacccgtccccaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcaggtatgggccagacccaggtggggctggggaccgagggacacaaggtggggggagcccagatcgcagcctccctgtcctccccacagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416486 - DNA, 1692 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcggggaggacgcctacaggagactggattcagcctgggcctgggcagtgggcaggggctgtgcgccacccccggtaacaggcccaggcggttccagacgtgggggcctcaacaacgtgtttgggggaaccccccggacgctcgaggccgggccccccgcggtgtcccgggaaaagggggcccat

SEQ ID NO: 416487 - DNA, 1833 bp, Homo sapiens
ggctagtagaggccggggttaatcggacgaggcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416488 - DNA, 2164 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416489 - DNA, 1845 bp, Homo sapiens
aggaccgggtggttgaatcggagagggctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416490 - DNA, 1857 bp, Homo sapiens
tgatggagaccacggggagcgggaggctgggctcctgggtctgggagaagaagtgtgtgaggaaaaaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416491 - DNA, 2169 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccgattccacccccgttttccgttgctccaggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416492 - DNA, 2536 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgagtgagtgctggggggcaggcggagacagccccgtgtgacgtccctcacgccccctctcccttccccactggcctttcccagggtcctgcccctaagcccaagctcagatcgaggttgacctgctgtcacagagtggctgaaataagaaggaagtgcgttctctcgcgtatgagtctgaggagcactcggggatggtgtggccgcttggctgcctgtagggccccggctctttccatcctgttggtcggccacctgcctcacggtgcgaggtgactgccccacctccagccatcacctccgcattcccaccagcaaggcgcttcttttctttaagaacatgtcactgcagctcacgttttacagaccagaactaattcccctggtcacacctagcgacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416493 - DNA, 1293 bp, Homo sapiens
  misc_feature (1184)..(1186): n is a, c, g, or t
  misc_feature (1193)..(1193): n is a, c, g, or t
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccccgggtttcccggggnnntgggccngcccgattttgggaagccccgtgggccctcaactcgccgtgggttcccacaggggggggccaggacagcacaaggccggcagaatcgcctaacgagtgag

SEQ ID NO: 416494 - DNA, 2065 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416495 - DNA, 2075 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416496 - DNA, 1987 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcatggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggtgtggccggcggcctgaccaacctctccaagatgcccgcctgcaacatcatgctgctcggggcccagcgcaagacgctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416497 - DNA, 2088 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagagggaacgctgctgtccctccccaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctcaccaatgccaccatcatggtcgtcagcgtcaccgcctccaccacccaggggcagcagctgtcggaggaggagctggagcggctggaggaggcctgcgacatggcgctggagctgaacgcctccaagcaccgcatctacgagtatgtggagtcccggatgtccttcatcgcacccaacctgtccatcattatcggggcatccacggccgccaagatcatgggctgtcgggcttctcgtctacctcagtgctgccccacaccggctacatctaccacagtgacatcgtgcagtccctgccaccggatctgcggcggaaagcggcccggctggtggccgccaagtgcacactggcagcccgtgtggacagtttccacgagagcacagaagggaaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416498 - DNA, 1219 bp, Homo sapiens
ctgtcttgtgaactgtcgtttgccaagcacccggcctggcacagcgttcaggtgttccgtgtccccttctcctttccctctccccatctcacccctggtctgggtgtgggggtgcagctgtgagtagcacagacaggacccctgccccgtggcgtggacattcttgttggggccgggtcaaagagacagtcaacaggtgaactctgtcctgcgtctagcggtgctaagtcaacaccaagaagaaaaagaaagggggtggcggtgaggcagcattaggtgctgatttaactaaggcacgtggatactcggggggcccgctcagaggaggcctgggtgggcagcccacgcgagcagctgcaggacctccccctcgccctccccaggtgggctacgaactgaaggatgagatcgagcgcaaattcgacaagtggcaggagccgccgcctgtgaagcaggtgaagccgctgcctgcgcccctggatggacagcggaagaagcgaggcggccgcaggtaccgcaagatgaaggagcggctggggctgacggagatccggaagcaggccaaccgtatgagcttcggagagatcgaggaggacgcctaccaggaggacctgggattcagcctgggccacctgggcaagtcgggcagtgggcgtgtgcggcagacacaggtaaacgaggccaccaaggccaggatctccaagacgctgcagcggaccctgcagaagcagagcgtcgtatatggcgggaagtccaccatccgcgaccgctcctcgggcacggcctccagcgtggccttcaccccactccagggcctggagattgtgaacccacaggcggcagagaagaaggtggctgaggccaaccagaagtatttctccagcatggctgagttcctcaaggtcaagggcgagaagagtggccttatgtccacctgaatgactgcgtgtgtccaaggtggcttcccactgaagggacacagaggtccagtccttctgaagggctaggatcgggttctggcagggagaacctgccctgccactggccccattgctgggactgcccagggaggaggccttggaagagtccggcctggcctcccccaggaccgagatcaccgcccagtatgggctagagcaggtcttcatcatgccttgtcttttttaactgagaaaggagattttttgaaaagagtacaattaaaaggacattgtcaaga

SEQ ID NO: 416499 - DNA, 915 bp, Homo sapiens
  misc_feature (858)..(858): n is a, c, g, or t
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaagtgatgggaccagtggaggccgcgcctgaataccgcgtcatcgtggatgccaacaacctgaccgtggagatcgaaaacgagctgaacatcatccataagttcatccgggataagtactcaaagagattccctgaactggagtccttggtccccaatgcactggattacatccgcacggtcaaggagctgggcaacagcctggacaagtgcaagaacaatgagaacctgcagcagatcctacttctcctatctctcccagtnctagctgctgcacactatactaatcacagcggcaacctgtcgacagtcagttaacca

SEQ ID NO: 416500 - DNA, 790 bp, Homo sapiens
acgtccacccgcgaatccctgcttaaaggccttgctttcttgtctaacgccgcaaccagtcctctgagttgccaacgtctttcttcttgtctcgacgccccgtcgtccggccacagcgattctctgcttagcaggatcggtccacagcgggacgtgagtccttttcctcctcgcggcttaccgcctctctccgcctagtgccaggtgctaataaagttgttgtttcaaatgcggccaggaacatcgcgagcggggaccaatcagagagtagctttgcctctataacggcgcgagagtgagacgtcatcggtgagcgactaacgctagaaacagtggtgcgcggagaggagaggcctcgggatgtctctggcagatgagctcttagctgatctcgaagaggcagcagaagaggaggaaggaggaagctatggggaggaagaagaggagccagcgatcgaggatgtgcaggaggagacacagctggatctttccggggattcagtcaagaccatcgccaagctatgggatagtaagatgtttgctgagattatgatgaagattgaggagtatatcagcaagcaagccaaagcttcagaaggtgcttcctcccactctgtgcccctccccatctcctgtctctcctgccaggccccctggctccctggctgcttgtggctgggtatatctccttctcagccttttccagagccttcttttttttttgtttcaccccaacccgttcccttttccactaaatatatattgcattgtaaagctcatgcttcttaag

SEQ ID NO: 416501 - DNA, 3603 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416502 - DNA, 510 bp, Homo sapiens
tggcgggctctggtcaccaggcttctgcaggtggcagtgtcgagcaagtgtaagatgtctgtgggaaggagaagctcctgaaatgaacgttctgcagaagcctggcgggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416503 - DNA, 574 bp, Homo sapiens
gggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcagtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416504 - DNA, 411 bp, Homo sapiens
ccatgtccacctcaccaccctcagcctccaaagaaaagtgagcagaactcttctcatttaaacctatatcattttgtcatccttttcagtgtgattctctggagctcctagctagaggggcctcaaggaccaagacaaggatattctactcacaatgtgacttccccaagtcataaagtagctgctgtgttttgttactaaacgtgctccccttgctgtcctccctctcccttttagagccatgggaccacaccaccaccaccacaaccaataggccaggaaccaccagagctccggcaaaacctccagggagttccctctggggtagcatgcaagtgaactacctacagttttaagccccatgtgtgcagaaacaatcaaggcatccatgtgaacactgagtttaacttt

SEQ ID NO: 416505 - DNA, 3529 bp, Homo sapiens
aacggctgatcggctccggaatttgggattcgctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416506 - DNA, 3439 bp, Homo sapiens
acctcctaccccacgagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416507 - DNA, 3456 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416508 - DNA, 1855 bp, Homo sapiens
gctttgggcgggaccctgcagaggcggcggggctcctcctcccgctcctcctcggcctccccttcgggcgctctcgcgctaactgtgctcctccggggccctccgcgaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccacctgcagaagcctggcgggctctggtcaccatgtgtctatctgaaggttgcactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416509 - DNA, 3102 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416510 - DNA, 3217 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416511 - DNA, 2826 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416512 - DNA, 1195 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggtgggtttctgaatcctgaggctcctgttggccatgtgaaaggaaaatgaatctcaggaccccaaaatcactaagccaagggaaaagtcaagctagaaactgcatcaggcaaacgtgcctcccattctactcctaaataagatagctgcaaagatggaaaaagctgcacgcctccctcacaatttgcctacaaagaaatttcttatgggcctcaatatctttaccctaaaacagttctgtgaatttcaccctggcaatacaaactgatagctgatctttacagagggagagagagccgtccctctgctcccctgatacaaatgcatctctggttgcttcctctgcccaattgcttatgtaaaaatgcaggttcactgagccagacaaaattgtgtattcagtgaaaggctgatcaaggactcaaaagaatgcaaccttttgtctctttctcttatctccctatgacctggaagcaccccacctctacccctgctttgagttgtcccacctttctggaccaaaccaatgtacgtcttacacat

SEQ ID NO: 416513 - DNA, 1091 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcctgccttaggaatgtaccacaaactagatggcttaaaacaacagaactttattctgtcactgttctggatgctagaagttctatatcaaggtgttggttgggccacattctctctgaaggctctagggaagaatctttccttgactttccccacttctggtggctctaggtgttccttggtttgtggttgcatcactccaatctctgcctctgttgtcacgtggtgttcccctttctgtgtctctctcctttctcttacaaagatgcttgttagtgggtttaaggcccacctggataatccaggatgatctcatcttgagatctttcacttaattacatctgcagagatcctttttccaaataaggaaatatatatttatagatatataatatatatacacatacatatatgtgcgcatatatatatacacacatcccttattcgttttaagcactgcacggtatgccatagtatgcattcagtaaatgtctgagtgccagctgtgtatcagttactgttttaggctttggggctacaggccatggacaaatcacacataaacctgtgccttgtggagccagcgttccagtagtgtggatttggccatgacctgtattgccatttccttactggcagacacgtggtttatttcctttttatgcaattacaaatagggctacagtggacattcttgtccatgtcctttgtgcctaagtgcattgtgactgctaggaccaaagatatgtgttttttatattataaaaaacgctgccaaattgttttccaaagtggatttgccattatgcactgtcactgatgttgttataatagtacctgttttc

SEQ ID NO: 416514 - DNA, 3551 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcaggagcttctccttcccacagacatcttacacttgctcgacactgccactggccagcatgggcctgtcccaagcgagaggggagacacagtggactgaaaggactggttgaaagtggccaatctctgtcagcttaatttggcagagaaaatttgtaacaactctgagcacatgctgggtgaagtcacagctcaaggaaagataaagctgggcggaaggaggtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416515 - DNA, 3332 bp, Homo sapiens
gctttgggcgggaccctgcagaggcggcggggctcctcctcccgctcctcctcggcctccccttcgggcgctctcgcgctaactgtgctcctccggggccctccgcctgctcccagccatggtggcctggcgctcggcgttccttgtctgcctcgctttctccttggccaccctggtccagcgaggatctggggactttgatgattttaacctggaggatgcagtgaaagaaacttcctcagtaaagcagccatgggaccacaccaccaccaccacaaccaataggccaggaaccaccagagctccggcaaaacctccaggtagtggattggacttggctgatgctttggatgatcaagatgatggccgcaggaaaccgggtataggaggaagagagagatggaaccatgtaaccaccacgaccaagaggccagtaaccaccagagctccagcaaatactttaggaaatgattttgacttggctgatgccctggatgatcgaaatgatcgagatgatggccgcaggaaaccaattgctggaggaggaggtttttcagacaaggatcttgaagacatagtagggggtggagaatacaaacctgacaagggtaaaggtgatggccggtacggcagcaatgacgaccctggatctggcatggtggcagagcctggcaccattgccggggtggccagcgccctggccatggccctcatcggtgccgtctccagctacatctcctaccagcagaagaagttctgcttcagcattcagcagggtctcaacgcagactacgtgaagggagagaacctggaagccgtggtatgtgaggaaccccaagtgaaatactccacgttgcacacgcagtctgcagagccgccgccgccgcccgaaccagcccggatctgagggccctgtccagctgcaggcatgcacaatggtgccaccgcttgtcacccggctccccccaccccttcatttggacccgcagctgctgtgctgctctgtgccatcggctccttgttggtctgagtttcccggatgagctctgggtgtttgtgagtttggtttctctgccctgccccaagcgtgctgagacttggtgccgaaattcaagagccagctctgatagaaagccagcaccagcctcgggagctgctgagccaccaactcccaaagccagcctgcctccagctttactgagcacaggatgcgggggccaagatgatgctgaggcctgatgacatttatgcttaggggacaagagtttgaactcaagggactgtgacccctgcacactggagtggctcattgtggcaggtttctgccaatagacagcccctgacagtggcctcaaggagctgcaggtggggggctcagcctgcacccacttggagcccctgcaaggagcgaaccggtcagcaccaagtaacaccacacacacgcagcacccaggatgatggtttcacttcagtcttccccatcccaggttttatgttgctgggcttccggagagccggtccaagcggaggctttcagtgatttaagtacaaacatgcatctcgtgatagtcctgccttgagagcttaggaatcttccggataagtatgaagcaattcgtaggcctgtttcccatctgattccatagggggctgggtgtggccttcgggttgacatgagaaaggtctttagcaatcatttctgcaccggagatgagttttatcctgtgttggggagaggtgctcaccctccaccctgtgtccctgttttggtagcaagagtgaccgatgtcaagaacgagcatcaaagccagaatcctgcttgtttgcttaaaaatgtaattgggggcggcgggggaggagaggggaaagagacattcgcttggtttagtgaaacgcaggtgactttgtagctctgtggtcagcctacttgtctgctctgagggagagtgcgtggggagccatgctcaccgtggcaaacacaggaaccccatgactcgcccctcacctggcgtggagctgcctggtttgggctggagcagagctggtttcctggaatgttcctttggcccacatatggttctgtcccggtgagctctgttgtcagaggctcacgggacagaaccacatgctagggtctagggcccctgtctactgatagtcagtttgctgtgtcagaaagcacttctgaaagcagatatgagtcaccagacaggcaggatcttacaaaactcacgggcctctttggtctgcatgatggccccatgcgtttcataggctgtccactgagcgggattgtctgctgagtgggatgagccaactccagtttcttaaggaaaccactggaatctgcagcccccacatgcatctgtctaacgcatgcctcgtgttcgttttgcaaacatgcctgtggtggagggtggtcagttgtagccctgtgcgtctcaaggctgccttgtgaggccattcccagtgcgtgcccttgagctccttaccaccccttttcctgctcggccctttaatccctgacagacctggactgtgtggctgaagggggacctgcagcactgcagaaatgcctctgcgtggtgccatgaaggaaagaaaccttggcctggtctcgagaagcttcccatgcttcaggaagttagtaagggtggggtggcttgcaggattggcctgtttccagggcctcccacactcattggccagattgtgaactttgtcaggcttgtccctccctgataccaagtatgtcgagaaccgatggccccaccctctggctggtgctgggccggaggtggctatggaggattttggcatgcgtggcctgtcgccacctggacagcgtgacctcaggggttgtccactttacctttatggtgaggcctgtcggatggctaagtccttgaaaccctagagctgtgacgtagaatatgtgctgtctgtgagaccgtgttcccaggagcactgactgcagttgagagagacccattttgctctcccttaccgccccccgccccgggtgctttctgcacaaagcctagagcctggcactcaagcccaccggtggcagctcctagtgactggacatgcctggaagacccctcagccttctgtttgcagaacgttcatttcagtgtgcgtggcttctggggtgggacccagaggggaggctctgggacaggggctggggttcagtgccagggccctgaggaagaaatggggactgatctcaaaattccagaattccctgtacatctgttcacgtgcttgtgtccaggtgtgacttgtaaactgtctagtgtttgcattaaataaaatggcaccgagca

SEQ ID NO: 416516 - DNA, 325 bp, Homo sapiens
acaaaataggccttatgaaatttttagcatgtggcatggtacgttatctgaaaatcctcctactgtacaacaccccaaaatgcttagtaaataaaatattgaaacaaatccttttaaatacatagtcggccttactcaaagtaaggaaaattccttgggagcaaaaatgtgtaagaattccatttccttttgtatggcaaaccaattattctgaagtgccttatcactgtaatataagtagatcctctttaaatttgaataagcctccttttttaatgcattgacaagcttgcaagaaataagggaaatctcaataccctcacac

SEQ ID NO: 416517 - DNA, 238 bp, Homo sapiens
ctggccccatttttcttttttaaaagcaaacaggtggggtgccatggctcacgcctgtaatcccaccattttgggaggccaagccaggtggatcacttgagtccaggagttcggagaccagcctgggcaacatggcaaaaccctgtgtctataaaaactaccaaaaaaaaaaaaaaaattagcgggatgtgatgctgtacgcctgtagtcctggctatctgaggggctgaggctggag

SEQ ID NO: 416518 - DNA, 1906 bp, Homo sapiens
tccaacttgtttgacacattagaaaaaatccatatccaattacaacagtaaatcgtgtaaagttgtcagggagtgttataatgacacgttttctctccctttctatctagggagcagtaatgaatgcaatggaaacaaacctcgttggaagtgacaaatatgctgcaagatttggggaatctatagttaatcttggcgacattgacaatgatggctttgaaggtaattaaaattatcaaattggtgcttgatttctgcttttaaaatggtttatggaagaaaatatgattaaagttttgtattgttttccttcctatagaagatggagccagaatggcatgctaagttttttcttttctttagtgttatatatgacttctcctcaattgtcacccattgatctttaccactgttaataatggatgatattcaaaataccttatttcagtgattctaaggcaccattgattagaaactgcattattatttatgtgtccctaaaagctacctattaagctgttacacccaccatttttctgttaaggaagatcctgatttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctatagctatgttgtggaggatctggggaattcaagaagagattctgagcaggccactgggaggcctggggacagtggctgtttacccactgatattgacgttttttattaattgaatagatggtagtgtggtaactgtgcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataaattctcatctccttaatgtcttcttgtacctagataccacaatctactttaaatatataaaatgcattattctacataaaaagtcagttattgaatacatgcttccagtgaaccttcttaaacgtaagatagtgtaacttgttatacaagtattactgttctggattttttgtttactattttaaaactgaaagaaaaaaataggtgtatatacttttggttattacgattacacataatttttttaaaaaacatgtatgaatgggagcctctctgtaccccacccatcactagcttccccctacttcccttaccctcccaggaccccaggttgggcattggctcattttcataaataacctcatcccagacaggggtgagggaaggtgttgtggctgttttgtttaaattggagctgtaagagggatcatgtcatattttatgcccttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcctggtttgattaaaaacaaaaaataaaatgttattatgcttgatgttacatctcataagtaaaaaaaaaa

SEQ ID NO: 416519 - DNA, 750 bp, Homo sapiens
cagtttaaatactttattataatttagaaaacaaacattcatgtcttgtttaaaggtaatttaaatgccactaaggaaagcagatgtttaatttcatatttatggaaagatgattttcaaaatgccattagagtatatattaaattctatataaaatattttaaaaatattttccaatgttgaaaattttaatgtagcacttttatattcccttcaagtactgcataaaagctgatccacattgtttaaatttcttgtgtaattttgggaaaatggaaagtggaaaagaagccagtgttcatatccaactggaaggccggccatccattttagaaatggtaagtaagtctaaaacattgacaacttggtggctaagtttacataaaatctataaattcagtcgtataggcaggatagtatgaaggcattcaacaaattaaattttaaataaaattttggagtaaaactctaaaactgtatttctatcacttcaactatctacattgactaagtgaaatggctttagaaattaacaggtaataaaggctaaaataggccaggcacagtggctcatgcctgtaatcccagcactttgggaggccaaggcaggaggatcacttgaggccaggagttcgagaccagttgtattcctaggtagatgtctggtgttatttctgaggtctctgttctgttccattggcctctgtatctgttttggttagccttgtagtacagtttgaagtcgggtag

SEQ ID NO: 416520 - DNA, 5259 bp, Homo sapiens
  misc_feature (90)..(90): n is a, c, g, or t
ggcagggcacacctggattgcattagaatgagactcactacccagttcaggtgtgttgcgttgtgggtctccggcacatttcagaggctnattaggaccctgaccccacactggggtttacacccctaaaagcaggtgtgtcccgtggcaactgagtgggtgcgtgaaaaggggggatcatcaattaccagctggagcaatcgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgattacacgctgatttagaaaatacagaaaccatacctcactaataactttaaaatcaaagctgtgcaaagactagggggcctatacttcatatgtattatgtactatgtaaaatattgactatcacacaactattt

SEQ ID NO: 416521 - DNA, 2710 bp, Homo sapiens
  misc_feature (90)..(90): n is a, c, g, or t
ggcagggcacacctggattgcattagaatgagactcactacccagttcaggtgtgttgcgttgtgggtctccggcacatttcagaggctnattaggaccctgaccccacactggggtttacacccctaaaagcaggtgtgtcccgtggcaactgagtgggtgcgtgaaaaggggggatcatcaattaccagctggagcaatcgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtggaccccaccatagggcaagtcctggaaagattcacgttgcctgttacttctggtttaaagagcataaagttttcagtttcaactccatctcatcttgcctccttaatataaaagggattccctttctgttaatatcgttctcccttttccttatggcaatgattgcagtactctgacaactatgctagagaaatttcttatgataccttctcttcatctctccccgtctctccgtgtgtaaagcacattttagactctctcagcgtattaaggacaggatccagctaagccaagacttgagaattttatttccatctttgacctatcaaccctcttaaagaacaggctaaggagcatatcaggaatagcaattggaattgatcccatatcccgtcgtttaacctaaaggcctaaaaaaaaagtgatagttttacttacaatatacaatctaaaagaaaaggaaaattggcatcttcatcgttaatgtagtataattttccattcccaaaaccgtcatccaaaactcatgttatatgggtccatctttttgcagtcatttctcaatgtctcagatttgtgacaagttgaaaaatgtgtactgatagaggggagaagtttcatgtttcaaagccaaagacaagtttgttgcacacaggcaagtggggaaagaagaaggaatattaaataacaagacctatcttgttccaaagtgttactgctatatatattgcttaacttttttccccttaaagcaaccctgggtcatggttgacattgttcctagtttatgtatgaggactgtggctcagagttgcaaatacctttttaaaagttacttagctagtgactgataggtgggaactaaagtcaaactagggtctgaatgcgtccaaagtctaagccattttcttccatgtatgtatcttcaatgcaaataaaattaagtgtaatggtttaatatgttgtctgctgagctgatgggtcatctgtaaacggtgaataaaattggtacttctttatatttctttgctataaatggacttttgagattagttattggatctttaacttcttttgtattttatagtagtctttgctctttttcaaactgtgaagctggttcccttcattcagatgaattcagatagagtataaacataatggaatttttac

SEQ ID NO: 416522 - DNA, 5196 bp, Homo sapiens
  misc_feature (90)..(90): n is a, c, g, or t
ggcagggcacacctggattgcattagaatgagactcactacccagttcaggtgtgttgcgttgtgggtctccggcacatttcagaggctnattaggaccctgaccccacactggggtttacacccctaaaagcaggtgtgtcccgtggcaactgagtgggtgcgtgaaaaggggggatcatcaattaccagctggagcaatcgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaagttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgattacacgctgatttagaaaatacagaaaccatacctcactaataactttaaaatcaaagctgtgcaaagactagggggcctatacttcatatgtattatgtactatgtaaaatattgactatcacacaactattt

SEQ ID NO: 416523 - DNA, 3961 bp, Homo sapiens
tggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgattacacgctgatttagaaaatacagaaaccatacctcactaataactttaaaatcaaagctgtgcaaagactagggggcctatacttcatatgtattatgtactatgtaaaatattgactatcacacaactattt

SEQ ID NO: 416524 - DNA, 557 bp, Homo sapiens
atgttccaatatcatttttcacatttctgcaaggttaaggccattttatcagcttagaacctatatccaacctgctgtaatttggctgggtttttgtgtttctgccacagacatttaatcactcccaaatctgtcaaaaaaatttctacaatttcagaggtacttgatatattttagcaaagataagctactggaacttttaaaaccaggttgctttttgctgttttttccagtgttgaaagataagatttctcttgctttctgtcttcatagactactactggagaatgccactttgaaaattatcaaagagtgtgtgcattagagcagcaaaagagtgcaatgcagaccttgaaaggcatagtccggttcttgtccaagactgataagaggctattggtaagtttcagtttttcaggttgtagttcctgctttccaacagagaagtgagacacttaaaatcaagtcaatgggtttgagctgtcacttcaataataagagagaagacaagtttaggtagtattcttgcgtggaaggaacaagcatggttggaaagt

SEQ ID NO: 416525 - DNA, 439 bp, Homo sapiens
atgcggtggtggggtggagaacaatggtaaatggtaacttacctctttctgtagtctaatatttaaatcaagttatttgcaaggtagctgtttaatcaaaggatttcaataaaatgatactatataaattaataccaagaccacactttgggaaccaaaggaggcactgcagttaattttaagtggtgaaataaattggggaaggtaaattgtgaaaacctctagctagaaggtaaagatcctgataaattatgtctttatgaaataaaccaggctatggtgatccttcttttattaaacaggatgagacttcagcactcaagtttgaaataagagcaacaggttttccagagccaaatccaagagtaattgaactaaacaaggatgagaatgttgcgcatgtaagattaccctcttaactgctacattaaaattatag

SEQ ID NO: 416526 - DNA, 5351 bp, Homo sapiens
  misc_feature (90)..(90): n is a, c, g, or t
ggcagggcacacctggattgcattagaatgagactcactacccagttcaggtgtgttgcgttgtgggtctccggcacatttcagaggctnattaggaccctgaccccacactggggtttacacccctaaaagcaggtgtgtcccgtggcaactgagtgggtgcgtgaaaaggggggatcatcaattaccagctggagcaatcgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgattacacgctgatttagaaaatacagaaaccatacctcactaataactttaaaatcaaagctgtgcaaagactagggggcctatacttcatatgtattatgtactatgtaaaatattgactatcacacaactattt

SEQ ID NO: 416527 - DNA, 4053 bp, Homo sapiens
tggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgattacacgctgatttagaaaatacagaaaccatacctcactaataactttaaaatcaaagctgtgcaaagactagggggcctatacttcatatgtattatgtactatgtaaaatattgactatcacacaactattt

SEQ ID NO: 416528 - DNA, 4097 bp, Homo sapiens
  misc_feature (90)..(90): n is a, c, g, or t
ggcagggcacacctggattgcattagaatgagactcactacccagttcaggtgtgttgcgttgtgggtctccggcacatttcagaggctnattaggaccctgaccccacactggggtttacacccctaaaagcaggtgtgtcccgtggcaactgagtgggtgcgtgaaaaggggggatcatcaattaccagctggagcaatcgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaaggtaattaaaattatcaaattggtgcttgatttctgcttttaaaatggtttatggaagaaaatatgattaaagttttgtattgttttccttcctatagaagatggagccagaatggcatgctaagttttttcttttctttagtgttatatatgacttctcctcaattgtcacccattgatctttaccactgttaataatggatgatattcaaaataccttatttcagtgattctaaggcaccattgattagaaactgcattattatttatgtgtccctaaaagctacctattaagctgttacacccaccatttttctgttaaggaagatcctgatttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctatagctatgttgtggaggatctggggaattcaagaagagattctgagcaggccactgggaggcctggggacagtggctgtttacccactgatattgacgttttttattaattgaatagatggtagtgtggtaactgtgcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataaattctcatctccttaatgtcttcttgtacctagataccacaatctactttaaatatataaaatgcattattctacataaaaagtcagttattgaatacatgcttccagtgaaccttcttaaacgtaagatagtgtaacttgttatacaagtattactgttctggattttttgtttactattttaaaactgaaagaaaaaaataggtgtatatacttttggttattacgattacacataatttttttaaaaaacatgtatgaatgggagcctctctgtaccccacccatcactagcttccccctacttcccttaccctcccaggaccccaggttgggcattggctcattttcataaataacctcatcccagacaggggtgagggaaggtgttgtggctgttttgtttaaattggagctgtaagagggatcatgtcatattttatgcccttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcctggtttgattaaaaacaaaaaataaaatgttattatgcttgatgttacatctcataagtaaaaaaaaaa

SEQ ID NO: 416529 - DNA, 2183 bp, Homo sapiens
cgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaacgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggaggctatggggccctacgtcttccttctatttgcggtcctcctgctgggcttcttcatcttcaccttcttaagagtacctgaaactcgaggccggacgtttgaccagatctcagctgccttccaccggacaccctctcttttagagcaggaggtgaaacccagcacagaacttgagtatttagggccagatgagaacgactgaggggccaggcaggggtgggagagccagctctctctacccggcccagagaccccttcctttcctctgcagcactttaaccctctcttccctattatttccgggtggaaaagaatccctgcagcctggtagaattgggaagctgggggaagggtggtctgagcaccccctcattcccctcgtgtgactctcttggattatttatgtgttgtggtttggccgtggccatcagggtgggccactctcccctccctcttccttcccccatcccctttcctccccaccttccccagactcagctccagaataccttcttcgctgctagagaagggggattggagggaagacaggtctagactttctcagtgggacaaaccagagcagagagcaggacaggagacaagaaatccagtttcccaccaccttggactcctcccacaatctgggactttcact

SEQ ID NO: 416530 - DNA, 1934 bp, Homo sapiens
gctgatgataataatgcacgtgttaatttatgaaaccagcactgtcaaggatattgttaacatgtgatgttgattttcacaacactctcacagataggtaggcaaggcaggcaacatcacccccatctcacagaggacactcaggttcggggcagggaagtgacttggccaaggtcacacaaatctgagctcttaaggccaagcctgtctcaaggtcacagaagaattttgagacaagttctcaaacatttctctgccttatggacccaaacatccagtttctcctttatgcccaggttgcagttcagctcctgtttacattgagatctttgtgcaattcctaatatggcccagtttccctcacccaacatgttgggtggagcccagtatcttcaggctccagctgggcccgggcccctagcggaaggaaaaaaatcatggttccatgtgacatgctgtgtctttgtgtctgcctgttcaggatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaacgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggtaggtccccccgccccagcctcccacaccgtaggccagaggtgggcatcacacagctagcccacctgcttccccgtcagggactcctccagccacagaccatgggtctttgggtcagtttggtggaccacctgctccacagaatcaaagcaaggaaggg

SEQ ID NO: 416531 - DNA, 557 bp, Homo sapiens
gtggtctgctcctgagggatttgggctgcactgggaggcagctgtggcacaactctggcagccaggagggagagcccctgtcaagcctcaggaacaatcattcctaaggacccagctttagagtccagggagagctgaccgtcataagaactgagaggccataacatttcctctgccttgaacccacttgggatagccagcagaatgccagtcaagggcctgctctaacccgggacagcaggccccctacaagctgctgcggagggggttaggtttcacttctctgagttgagggcaagggaagatcagaaaggcctcaactggattctccaccctccctgtctggcccctaggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcg

SEQ ID NO: 416532 - DNA, 1686 bp, Homo sapiens
cgctccaccagatccgcgggagccccactgctctccgggtccttggcttgtggctgtgggtcccatcgggcccgccctcgcacgtcactccgggacccccgcggcctccgcaggttctgcgctccaggccggagtcagagactccaggatcggttctttcatcttcgccgcccctgcgcgtccagctcttctaagacgagatgccgtcgggcttccaacagataggctccgaagatggggaaccccctcagcagcgagtgactgggaccctggtccttgctgtgttctctgcggtgcttggctccctgcagtttgggtacaacattggggtcatcaatgcccctcagaaggtgattgaacagagctacaatgagacgtggctggggaggcaggggcctgagggacccagctccatccctccaggcaccctcaccaccctctgggccctctccgtggccatcttttccgtgggcggcatgatttcctccttcctcattggtatcatctctcagtggcttggaaggaaaagggccatgctggtcaacaatgtcctggcggtgctggggggcagcctcatgggcctggccaacgctgctgcctcctatgaaatgctcatccttggacgattcctcattggcgcctactcagggctgacatcagggctggtgcccatgtacgtgggggagattgctcccactcacctgcggggcgccctggggacgctcaaccaactggccattgttatcggcattctgatcgcccaggtgctgggcttggagtccctcctgggcactgccagcctgtggccactgctcctgggcctcacagtgctacctgccctcctgcagctggtcctgctgcccttctgtcccgagagcccccgctacctctacatcatccagaatctcgaggggcctgccagaaagagtctgaagcgcctgacaggctgggccgatgtttctggagtgctggctgagctgaaggatgagaagcggaagctggagcgtgagcggccactgtccctgctccagctcctgggcagccgtacccaccggcagcccctgatcattgcggtcgtgctgcagctgagccagcagctctctggcatcaatgctgttttctattattcgaccagcatcttcgagacagcaggggtaggccagcctgcctatgccaccataggagctggtgtggtcaacacagtcttcaccttggtctcggtgttgttggtggagcgggcggggcgccggacgctccatctcctgggcctggcgggcatgtgtggctgtgccatcctgatgactgtggctctgctcctgctggagcgagttccagccatgagctacgtctccattgtggccatctttggcttcgtggcattttttgagattggccctggccccattccttggttcatcgtggccgagctcttcagccagggaccccgcccggcagccatggctgtggctggtttctccaactggacgagcaacttcatcattggcatgggtttccagtatgttgcggtaggtccccccgccccagcctcccacaccgtaggccagaggtgggcatcacacagctagcccacctgcttccccgtcagggactcctccagccacagaccatgggtctttgggtcagtttggtggaccacctgctccacagaatcaaagcaaggaaggg

SEQ ID NO: 416533 - DNA, 3267 bp, Homo sapiens
  misc_feature (27)..(27): n is a, c, g, or t
tatctcgtagcatgttggcctatgggngagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcaggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttc

SEQ ID NO: 416534 - DNA, 3126 bp, Homo sapiens
  misc_feature (27)..(27): n is a, c, g, or t
tatctcgtagcatgttggcctatgggngagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcaggatcctctagtaacccgggcaacaccgtgcc

SEQ ID NO: 416535 - DNA, 2395 bp, Homo sapiens
  misc_feature (24)..(24): n is a, c, g, or t
gggcccgggtgccctgttcgatgntgtataaaatctctgtgggtcctggcggactaatgtgcaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcaggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttc

SEQ ID NO: 416536 - DNA, 1989 bp, Homo sapiens
cgtttctcgcataactgcctatttgcagccagtatcctgcactccaattacttgctatactgcgtaagctgggagctagcctcttcaaacgcagctgctcagtcgaccaagatcggtagcaggatgagatacgaggcaggaagggcatcgcagtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcaggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttc

SEQ ID NO: 416537 - DNA, 3361 bp, Homo sapiens
  misc_feature (27)..(27): n is a, c, g, or t
tatctcgtagcatgttggcctatgggngagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtgagcccctgactttccagcactcagacctttcgtcaccatcctggtcccccattgcctccactgacttccctccccgccatctgagttgcaggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcaggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttc

SEQ ID NO: 416538 - DNA, 1606 bp, Homo sapiens
acttgtgagcctccttgtgtgacctacatgcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcaggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttc

SEQ ID NO: 416539 - DNA, 3365 bp, Homo sapiens
  misc_feature (27)..(27): n is a, c, g, or t
tatctcgtagcatgttggcctatgggngagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgcacaagctggctgaccagcggaccaggaaatctctgggccgaggggaattccgccttctgcactatgcgggggaggtgacctacagcgtgaccgggtttctggacaaaaacaatgaccttctcttccggaaccttaaggagaccatgtgtagctcaaagaatcccattatgagccagtgctttgaccggagcgagctcagtgacaagaagcggccagagacggtcgccacccagttcaagatgagcctcctgcagctggtggagatcctgcagtctaaggagcccgcctacgtccgctgcatcaaacccaatgatgccaaacagcccggccgctttgacgaggtgctgatccgccaccaggtgaagtacctggggctgttggaaaacctgcgcgtgcgcagagccggctttgcctatcgccgcaaatacgaagctttcctgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccactctcccattcatgccactcgtggagcgcacacggcaccaggctcccagctggctccccgcgctctggccaattgcctttctttcccaaccgcagccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcaggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttc

SEQ ID NO: 416540 - DNA, 1660 bp, Homo sapiens
  misc_feature (118)..(118): n is a, c, g, or t
ggatgattatgtgaagtatgatcctgtagcactaagagacaatgactgtaagtctttcgggactatcgtgcaggtctgatccatatgcttcagtgatcactactagccttacatgtangcgcgattagatttcaaccagcagcctacggtggacctgagtttgaattgtgtcactagtacgtgctgtcattcacttttcaatatagtctgggatagaccaacatggtgaaagatcctagacactctaagggatgccctgctagggtgcgcatgacatcaggtccctaatagattgccaaatcggtcactgagcctggtttcgaggaccgtgcttattctcggcacacaggtgaagtatcctggggtgtccggaatagctgcgcgtgtgacatagccagtgattcgagtttcgcctggatttactgaattcttttgaatgcaaaggtacaagtcactgtgcccagagacgtggcccacgtgggcaggacggccgcaggatggggtggctgtgctggtccgacacctgggctacaagccagaagagtacaagatgggcaggaccaagatcttcatccgcttccccaagaccctgtttgccacagaggatgccctggaggtccggcggcagagcctggccacaaagatccaagctgcctggaggggctttcactggcggcagaaattcctccgggtgaagagatcagccatctgcatccagtcgtggtggcgtggaacactgggccggaggaaggcagccaagaggaagtgggcggcacagaccatccggcggctcatccgaggcttcatcctgcgccacgccccccgctgccccgagaacgccttcttcctggaccatgtgcgcacctcttttttgctaaacctgaggcggcagctgccccggaatgtcctggacacctcgtggcccacgcccccacctgccctgcgtgaggcctcagagcttctgcgggagttgtgcataaagaacatggtgtggaaatactgccggagtatcagccctgagtggaagcagcagctgcagcagaaggccgtggctagtgagatcttcaagggcaagaaggataattaccctcagagtgtacccaggctcttcatcagcactcggcttggtacagatgagatcagcccccgagtgctgcaggccttgggctctgagcccattcagtatgcggtgcctgttgtgaaatacgaccgcaagggctacaagcctcgctcccggcagctgctgctcacgcccaacgccgtcgtcatcgtggaggacgccaaagtcaagcagaggattgattacgccaacctgaccggaatctctgtcagcagcctgagcgacagtctttttgtgcttcatgtacagcgtgcggacaataagcaaaagggagatgtggtgctgcagagtgaccacgtgattgagacgctgaccaagacagccctcagtgccaaccgcgtgaacagcatcaacatcaaccagggcagcatcacgtttgcagggggccccggcaggatggcaccattgacttcacacccggctcggagctgctcatcaccaaggccaagaacgggcacctggctgtggtcgccccacggctgaattctcggtgataaaggcgcccactggaccctcccaacgcccaatgctttgcttttc

SEQ ID NO: 416541 - DNA, 1914 bp, Homo sapiens
  misc_feature (27)..(27): n is a, c, g, or t
tatctcgtagcatgttggcctatgggngagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccagtatttcaacaacaaaatcatctgtgatctggtggaggagaagtttaagggcatcatctcgattttggatgaggagtgtctgcgccccggggaggccacagacctgaccttcctggagaagctggaggatactgtcaagcaccatccacacttcctgacgtgagtggggctgcggggctgctgggggcaagggctcacttgcagcagagcctgcggagtgcaggagtccctccgccatcacaaaacaccagccacaaggaggtgaccagggacggtgctgagttaaggacccctcacatgtgtccagaaactaagaagcttagccaggcatgctgacacgcctggagtcccatctatgcagaaggctggggcaagagcatcacttgagccctggagttttgaggttgcagtgagctaggatcaacccactgcactccagcctgggtgacaagagcgagactccgtctca

SEQ ID NO: 416542 - DNA, 1728 bp, Homo sapiens
  misc_feature (27)..(27): n is a, c, g, or t
tatctcgtagcatgttggcctatgggngagtgcgcccgggccgcggatccccaagcccgccacgccgcccagcccggccccgcccgcgccggaagagccacgccggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacggaacccccagagctacctgtacctggtgaagggccagtgtgccaaagtctcctccatcaacgacaagagtgactggaaggtcgtcaggaaggctctgacagtcattgatttcaccgaggatgaagtggaggacctgctgagcatcgtggccagcgtccttcatttgggcaacatccactttgctgccaacgaggagagcaatgcccaggtcaccaccgagaaccagctcaagtatctgaccaggctcctcagcgtggaaggctcgacgctgcgagaagccctgacacacaggaagatcatcgccaagggggaggagctcctgagcccgctgaacctggagcaggccgcgtacgcacgagacgccctcgccaaggctgtgtacagccgcacttttacctggctcgtcgggaagatcaacaggtcgctggcctccaaggacgtggagagccccagctggcggagcaccacggttctcgggctcctggatatttatggctttgaagtgtttcagcataacagctttgagcagttctgcatcaattactgcaacgagaagctgcagcagctcttcatcgagctcacgctcaagtcggagcaggaggagtacgaggcagagggcatcgcgtgggagcccgtccaggccttgggatgacagacagcttgcccgcacactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccagagaaacactaaataaagcaatacgtgtttgccgaa

SEQ ID NO: 416543 - DNA, 153 bp, Homo sapiens
ccagggtgtccaggacctctgacctcactcctccccttaggcctcagagcttctgcgggagttgtgcataaagaacatggtgtggaaatactgccggagtatcagccctgagtggaagcagcaggtacggagagcggggctgggtgaggatga

SEQ ID NO: 416544 - DNA, 543 bp, Homo sapiens
attttctaggagactgtttctaactttggttttaggaacactataatagtgagtcagtataggtaagtggttaatgctaaagatttatagccaagttgacctggctaaccttggacaagctgtttaacctttttgagactcttttgtaaaatatttatttttattttccttcatttttaaaaatccagatcctgcacaatcttttatttataaaatttgggtacctaatagagtttttgtgaaggttaaatgagataatataaataagataccttagcaccatccctgctgtaaaatcatcacctagtggtaaatcttatatttgtagggaagtgtttgtagtatattggcaagaacatgggcaattagtattagaaagacttaaggtcactcacaaaacaaaaaagaaagacttacagtcaagttctggctatactactgaacagctaagtgaccttaggcatgttgcttaacttctctgagcctttttaaaaaaatctacaaagaaggggccaggcgcagtggctcacttctgtaatccca

SEQ ID NO: 416545 - DNA, 422 bp, Homo sapiens
gttagttgtcttataaccgatcagtggtatctcatctcactcagaataaaactcagagtctacagtggtctacaatgctttacattatttggccccccactataagtcttactttattttctattcctaatgtgttcctgacatgccagcctccttgctcttcttcatatactgcaagtgtgcctcctgctttagctggcctctctacctgaaatgttttcctcctcttgtctgctggataattctctcagctcatttaaggttgccaaaatctcactttctcaatgaatcccccattgaccactctaatattgaagaccccaccactttacatattgcagttctccggatcccccttgccttgtctacattttcttctttcaaaagcattttcacctcctacatattaaattttactaatt

SEQ ID NO: 416546 - DNA, 409 bp, Homo sapiens
attaaaatgaaagctaagactgatttattctagctctcaggatagaactaggaaaaataagcagagttttcagtgggttttgactaaatataaagaagatgaagtacaaataatatgtaatagtggagtggatatcacagttataaactttcagcctctgttagcatttaaacagaggatacctgaccactctgaggggtgttgtgattaggaatatgtgatttgagggggctaaaattagatgctgtgatttttcaaaagatattttttaatggctttgttgaatggcaggattttattttaaaaactcatgaaaatcttgatttttgatttgttaatctttgctttataactgagaattttaaaaatatctaggggaatggccgttagttatcatttaaaaaatttt

SEQ ID NO: 416547 - DNA, 379 bp, Homo sapiens
aagaaaagaaaaagaatctgcattttaacaagagtccttggtaattcacatgcacattgaagtttgagaagcctggctccaactgtctaaaatgtcctggcctcagcaattagcctagacagctgggactccatgtgtccctgtatatgtctgtacccctttcatgtgcctgctatcttgtactgcctgaccaagctatgtgcccttagatttgggaaatatgtatctcctgaaaatcaagtctgtgctttgtctttattgagcagtcagccctgtttcaacagtggtagctgccttcatctgcgtgctagagggctgggctggacttcagctttcacctaggaaatgagtcttgctgccctttccagaaagtgacaca

SEQ ID NO: 416548 - DNA, 2175 bp, Homo sapiens
gtgtgtgtgtgtgtgtgtgtaaatgggatcttgctgtgctgcccaggttggctggtcttgagttcaggtgatccacccacctcggcctctcaaagtgctgggattacaggtgtgagccaccattccgggccctaaaacagtttttttagctcgtcagctatcgttaatgttaatgtattttatgtgtggcccaagacaagacaattcttcttccaatgtggcccagggaagcccaaaggttggacacccctgaaaattacatatcttctccaacagagtgttttgttacaacagccagaagcctgatgaaagatttatactgcttgggacaagttttaatgattgttaatttttactttgaacaaatagtgaatgaaataatagatttgacattttttaagataacaagtgctaggaaatatgaagtgtgagtaaataaaaaggttcatatgttattagaactaatcattttgatgttatgcatagtgattactagaataattcccagagtttctttgacagagacgtcacattagtttaacttaccaaaacagacagaagaaatagaaaacttgagtagtcctattaaggaaataaaataattgaatcttttctacaaagaatattccagacctagatggcttcaatggtaaattctgtgaaacatttaagaaaaacaaaaaacaaacaaagaaaagaagttggagaagctttttcagagaatagagaagaaataaatacgtagacttattttatgatctcagcataacattgatcacattacatgccaagggcattataagtaagggaaacaataatttagtgtaattttattacattaaaattgaaaacttctgtctgggtgtggtggctcacacctgtaatcctagcactttgggaggccgaggtggagggatcacttgagctcaggagtttgagaccggcctgggcaacatggcaaaaccctgtctctactaaaaatactaaaataagctgggcatggtggcacatgcctgtagtcccagatacttgggaggctgaggcacaagaattgcttgaacctgggaggtggaggttgtagtgagccaagattacaccagtgcactccagcctgtgtgacagcgagactctgtctcaaaaaacaaaaaaagaaggaaaacttctgttcatcatgaacattcatgcaaaaatactgagcaaaattatagcaaaccaaagccaatgatatatgcaaaatggtaatacatcatgactaatttagatttttttctaggaatgcaaggttggtttaaattttaaaaatcagtcaatatgattaacaaaataaagtaaaacctctgttaaagtaaaaccattaacagaataaagtaatagctgcagcaacaattttgataaaatttagcactataaatgattaaaaaaaacttttggcaaaggaggaatagaatagaacttccttaatctgtccaaaggttatcaacagaacactccacagccaatattacgtaatagtgaagtattgaaaactttcctcttgatatcaagaatgagattaagatgatcattatgggccaggcacaatggctcatgcttgtaatagtagtactttgggagtccaaggcaggcagatcacttgacgacaggagttcgagaccagcccagccttcacggcaaaacctagtctgtactaaaaatacaaaaattagtagggtgtggtgatgcgctcctataatcccaactactcgggaggttgaggtgggagaattgttggaacccaggaggcagaagttgcagtgaatggaggttgtgatgagctgggattgcaccattgtactccagcctgagcagcagagcaagactctgtctcaaaaaaaaaaaaagaaaagaaaagaaagatcagtatcacccacttctgtaccggaaattaacagacaattatttaataaggaaataaaaaggagtaagaaactcaagatttgtaagacagaaatgctattttatatagacctccctacagtcaatctacaggttaactattataatttacgactcaatttatcaaagtctctaaacacagtcaatatctgcaaatcaatgatatctctgtattccagccataaaaatttcaaaagtgaatcttaaaaatataatttaaagtagtatcagacccatcaa

SEQ ID NO: 416549 - DNA, 916 bp, Homo sapiens
aattgtttgggttaaaatttgaggaaggttcatcttgtacgtatttaagagaattttgttggtgaaaatccttaaagcttacttttaggattgaggctttctgaataattgagcttcccaccctttgagtgctgaatgactgtattttcatcaagtatttaatatataactcttggataatcaaaactttgattccaagcattttagtaagataaaacaaactgtcacttttttcttacatattttaacaaatcagaaataatggttccttttaatttttatataggaagaggcatatttctacaaaaaattgagatacctgaagaatgttctttccttgttaatgtgtaattaacaaaatcagcaaaagactcattttatgaatccatgaaagagaagttttataaatacaaatttccagcaagtacactctataaataaaaatagatttggtcttggtgaagctttgtcttataaataaaaattatgttaaacatgtataattttaaaatatgaagtgaagaaagggttcctagttttggaaattggcagcatatgcagaagatatgaacaataggtcaatgaatattggatttacagcattctttcctaaaattgagagtttctgtaatttataaattggatatttcttggctcaattctttgtactattccatttgggtaaagctgtttttcagaagaatttagaactatttttttcttgataaaaaggcaatgaaatgatttaagatttgtctgcaaaataattgcatgacacaaggttttcatggctaaaaataaagggtattgttgatttgaggagttagccagtgacaatgatgcttaatgtgtttgttcctcatgaactcacatttctgagtaaactttgaaatatgattaatagttcagtaggtct

SEQ ID NO: 416550 - DNA, 3625 bp, Homo sapiens
ttgggcgcttcgctgatggtgtcggtgagcgcgtttcccgcctgagcgcaactagcggcgggtcgtgggcacctccaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416551 - DNA, 871 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaaggatgcagtgaacaggcttgctttggccggtacgggcgggaggacaaaacctcatcatgaccactcgaggtgtggctgatatcaggacctgagcgtacagcagggttgaagaggacgga

SEQ ID NO: 416552 - DNA, 947 bp, Homo sapiens
  misc_feature (11)..(11): n is a, c, g, or t
  misc_feature (839)..(839): n is a, c, g, or t
  misc_feature (885)..(885): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaaggcacccaaggtacntgcatcgagctgagcgcccagcctgtgggacttatccgggtacacnaggtcctaagtggtggggcagcaacccaagaaaggctgctgggttcacccacaagggcacag

SEQ ID NO: 416553 - DNA, 912 bp, Homo sapiens
  misc_feature (11)..(11): n is a, c, g, or t
  misc_feature (804)..(804): n is a, c, g, or t
  misc_feature (850)..(850): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaaggcacccaaggtacntgcatcgagctgagcgcccagcctgtgggacttatccgggtacacnaggtcctaagtggtggggcagcaacccaagaaaggctgctgggttcacccacaagggcacag

SEQ ID NO: 416554 - DNA, 3388 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416555 - DNA, 3580 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaatgatcatacaagccaccatagtgaaggtgggcggaagacaagacaccatagtgaaggtgggaggaagacaagacaccatagtgaaggtgggaggaagacacacttgatgttttccaaggccacacatttactaaggtggcagaagtggaaataatcccagggtcatctgctttggggccagtgttcctcccagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416556 - DNA, 3353 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416557 - DNA, 3493 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccggtgagaggctgccttccccttcatacccccctcactccttcatcccatctgagccccagggccccattcttccattcggctgcatgctggcccctttccttgcagggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416558 - DNA, 2780 bp, Homo sapiens
gcggccgcctgagacctgggctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggtggctcaactcctcccacagcaccaacccagacagtgtgttgtttattccacagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416559 - DNA, 3298 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416560 - DNA, 3596 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtaggccccgcacttgtaccacgtggaaggtgagcaggaccctggggaggacagtaagggtgagtgccaacaaagaccttagggggctcctgggtgggggtgggggtatctgcacagtggagccctgtggcctgtcattagggccagcgcagaccaggcaaggggtcaggggtgtatgccccctgctgccatggccactcctccataggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 416561 - DNA, 1770 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccggtgagcctcagactgggtcctttcccttcttcctcctccactgctcctacacagcaaagctgggggaatgctgcccagcctccctgtgcactgggaggagatctcggccaactaggtaggtcactcacctctgcaaatccagggacagcctaggaggtacacgttgcctgcaaatcactgttcctcaggctggaaggtgctgtgggtgacagcaagagcccttagaattcagggaagggagcagtcacttccaaacgcaggaattctcatgaggaaagtagaattttgactgggcatggtggctcacgcctgtaatcccaacactttggcagaggtgggaggacagcatgagcccaggagttcaagacctacctgggtaacataatgatacttctttctca

SEQ ID NO: 416562 - DNA, 1225 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaaggtagccacatccgtggtctccggggccgggaggaacatctcagaaaactggtggcttcagaggcttgcaagatgagagtgggctttaaggctggaatttggaaatgcaaagagctgagaacttcataaaggaggctgagcccacaaacacaggggaggatacctggaggcttgtgagataggggctggcacagtgagagactaggctgggtggctatagtacaggagtgatcagaaatgagaggacaggctgggcgctgtggctcacgcctgtaatcccagcactttgggaggccgaggcaagcggatcacctgaggtcaggagttcaagaccagcctggccaacatggtgaaaccccgtctcta

SEQ ID NO: 416563 - DNA, 742 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcaggtaatacccccttctctttttatttccctgtaaaaaaatttacatttttttaaaagaccacttaacatcagtggtaaattctataagcaaacccaaccagtatctctttgctatatccctt

SEQ ID NO: 416564 - DNA, 1128 bp, Homo sapiens
tatccatcatattgaggtaccataatttatttaccctgccacctattgtacatttaaactgtttttcattttttgctattaataccaatgctatagacctttttacccaaatatccttgcatgcttgtttgtttgtttttgagacaatcttgttctcttgcccaggctgaagtgcagtggtacaatctcagcttactgcaacctatgccacctgggctcaaacagtcctctcacctcatcttctcatctgtgggaccaccacgcccagctaagttttgtacttttggtagagacaaagttttgccatgttggacaggctggtcttgaactcctgagctcaagcgatccacccgcctcagcctctcaaagtgttgggattacaggtgtgggccaccacacccagctgcacggttgtttaagtacatccttaggatgcagtcctagaagtggcatcgtttagtcaaaaggcacagactaaaaggcttttgctaaatgttgccccaagtttccctcctgaaaaactgtatgagtttaaactgggtgtaagtgaggagattgggactttagaccaggcactcactcagaggagttactgacagggcagggagggacgggggctccagagaaattggagtgtttgcgcttcttgtttgcagatgagccttcccagcgtccccgtcttcctagaggtttctggccagtttgatgttgagttccggcttgccgcggcctgccgcaatggaaacatctatattctgagaaggtagccacatccgtggtctccggggccgggaggaacatctcagaaaactggtggcttcagaggcttgcaagatgagagtgggctttaaggctggaatttggaaatgcaaagagctgagaacttcataaaggaggctgagcccacaaacacaggggaggatacctggaggcttgtgagataggggctggcacagtgagagactaggctgggtggctatagtacaggagtgatcagaaatgagaggacaggctgggcgctgtggctcacgcctgtaatcccagcactttgggaggccgaggcaagcggatcacctgaggtcaggagttcaagaccagcctggccaacatggtgaaaccccgtctcta

SEQ ID NO: 416565 - DNA, 847 bp, Homo sapiens
  misc_feature (11)..(11): n is a, c, g, or t
agcgggctggnagcgacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaaggtcagcgtcaggtctggccctgggcccgctggaggcccaggctgcattctctccccatgctccacagttagttctgggtaatatatatgttccttgtagaaaaattagaaactagataagcattaaaaaagatatatat

SEQ ID NO: 416566 - DNA, 1300 bp, Homo sapiens
ccacgcgtccggggaaaccgaggcctaagatgtgcatatgtgtgtctggaggtcgctcggtgagccagtggcggagcctggacttgtacccagacgttctgtaccttatgttcagagtgacctgtaccagcttcctcaaagtttttttttcccctcccatgggactcactccccaactgtctttcccccacttccagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaaggtagccacatccgtggtctccggggccgggaggaacatctcagaaaactggtggcttcagaggcttgcaagatgagagtgggctttaaggctggaatttggaaatgcaaagagctgagaacttcataaaggaggctgagcccacaaacacaggggaggatacctggaggcttgtgagataggggctggcacagtgagagactaggctgggtggctatagtacaggagtgatcagaaatgagaggacaggctgggcgctgtggctcacgcctgtaatcccagcactttgggaggccgaggcaagcggatcacctgaggtcaggagttcaagaccagcctggccaacatggtgaaaccccgtctcta

SEQ ID NO: 416567 - DNA, 1026 bp, Homo sapiens
caacatggtgaaactaaaaatacaaaaagtagctgggcacggtggcgtgcgcctgtaatcccagctagttgggaggctgaggcaggagaattgcttgaacctgcgaggcagaggttgcggtgagccgagattgtgccactgcgctcctgcctgggcgacagagcgagaacctgtctcaagaaaaaaaaagactgcatagtttttgatcatatggatggctcataattgacttagacaatcctcttttgttagaaagttagatttgttgcaataaacacctttgtacttaaatcttctgtcacatctctgatatttcctcttcatcctcctttgccctctttcttccctcatgtggcattctgggagtatcttgggggtggtgtgtggaggttccctgggtgacccctggagtccttctgtagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaaggtagccacatccgtggtctccggggccgggaggaacatctcagaaaactggtggcttcagaggcttgcaagatgagagtgggctttaaggctggaatttggaaatgcaaagagctgagaacttcataaaggaggctgagcccacaaacacaggggaggatacctggaggcttgtgagataggggctggcacagtgagagactaggctgggtggctatagtacaggagtgatcagaaatgagaggacaggctgggcgctgtggctcacgcctgtaatcccagcactttgggaggccgaggcaagcggatcacctgaggtcaggagttcaagaccagcctggccaacatggtgaaaccccgtctcta

SEQ ID NO: 416568 - DNA, 1278 bp, Homo sapiens
  misc_feature (1170)..(1170): n is a, c, g, or t
  misc_feature (1216)..(1216): n is a, c, g, or t
ttgggcgcttcgctgatggtgtcggtgagcgcgtttcccgcctgagcgcaactagcggcgggtcgtgggcacctccaggctcagacgtgcagcttctggaatacgaggcgtcagctgctggcctcatccgatccttctctgagcgtttcccagaggatggacccgagttggaggagatcctcacacagctggccacagccgatgcccgattctggaagggccccagtgaggccccatctggccaagcttgaggaagatgtgtggccttgcccccaattccatcagaccaaggctgcaagtggccctccattcgtcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggggagacggcagaggagcctttgtccatccagtcactcaggtaaggaccctgtggagggccagggtttgggaggctccagggagaggaagcagccgccagaatgtgccagaatgatggaggagggcagcgaggccggggcctgcagatgccagttctctgtgtgtctaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaaggcacccaaggtacntgcatcgagctgagcgcccagcctgtgggacttatccgggtacacnaggtcctaagtggtggggcagcaacccaagaaaggctgctgggttcacccacaagggcacag

SEQ ID NO: 416569 - DNA, 455 bp, Homo sapiens
ggccaactcaaagtgggaaagacattggcgtgtgctcctcgaatagagaggaactaactgtactttctggaaagggaaactaaaattgagaggccagtaaactaaaaactgcattgacacagggcaaagctcttcatccttttctcataataaagtgcctaagtccacttgtcctggctagtccagccaaaggtaaactcactgaaaactctgttaaatgctagatgatcatacaagccaccatagtgaaggtgggcggaagacaagacaccatagtgaaggtgggaggaagacaagacaccatagtgaaggtgggaggaagacacacttgatgttttccaaggccacacatttactaaggtggcagaagtggaaataatcccagggtcatctgctttggggccagtgttcctcccaggtgagtccatgaggtttagacagaggagggtcagcca

SEQ ID NO: 416570 - DNA, 444 bp, Homo sapiens
gggttttttttttcccctttaaaaaaaaattttttgtgggggtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416571 - DNA, 443 bp, Homo sapiens
agtaggagcagtcccagcatgcagtgcagctgggtgaggggtgggacagagagtaggagcagtcccagcatgcagtccagctgtggtccggctttgggagagtggtgaattgcgctgcccgaactcggagcggagcagggtagggaccgtgtacagcttgataacccttaataaaaagggagtttgaccagaaaaaaaaaaaaaaaaaaaaaaaaaaaaaaaaaaaaaaaaaaccccggggcggcctttattttccgggggcgcggaaaaaaaggggtgtaatataaaagggggcgcaccatggggccatatcgcgttgtgttctccgggacccccagtttttttttgtcacaaggggggaaaatctctggcggcgggtctccccacatatatagagagagagagtcgcagatatatatatatttccagaaaacccgggttac

SEQ ID NO: 416572 - DNA, 3770 bp, Homo sapiens
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416573 - DNA, 4002 bp, Homo sapiens
cgcgcgaggttgtccgctgttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416574 - DNA, 3718 bp, Homo sapiens
agcgggcggacacccggcctagcgccgcgggtcgcgccgagccgagccgagccgagcggagccggcggagcctctggaatcacccgggtcgctgttcctgaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416575 - DNA, 3950 bp, Homo sapiens
cgcgcgaggttgtccgctgttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416576 - DNA, 3724 bp, Homo sapiens
tagggtattcgtgctggtgctaagggtattcgtgctggtgcttagggtattcgtgcaaagtgctaagggaattcagtgctggtgctaagggaattcgtgatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416577 - DNA, 2356 bp, Homo sapiens
ggattacggctattcgttcgaccacgcctcgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416578 - DNA, 2327 bp, Homo sapiens
cctagtcaggcgggtggtaatcggacgatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416579 - DNA, 3830 bp, Homo sapiens
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccagaaaaaaacacccgccccccaccacgccccccccacatacacacacaccaaccacaaccagc

SEQ ID NO: 416580 - DNA, 3555 bp, Homo sapiens
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgtctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416581 - DNA, 1641 bp, Homo sapiens
ggagggcacggcagccctcagcagcttgtgtgggtctcagagaagttcacagctgctgtctgtctctgttgggagagacagggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416582 - DNA, 1951 bp, Homo sapiens
tgcagctgccgtttccctgagactttctctgatcactctcagtaaaaggctcccttgcccaccctcctgaatcttcctgtcttagttttctccatagcatttagcaccatgtgacatatcatgttttttccttatttatttgcttattccatatctcctctaccagtatataagcctcacaagggctggcatttctgtctgttttgttcactgctatctccccacacctaaaagagtgcctggcacttagaccgtcagtcagtttgttcctgaatcaaatgaataggtaaaatgagggccattacaacacaggcttcttccggggatctgctgtgaatgtaacctgtaaagatcagaggtatattacacactattaacataataggtgctctgaggcaaggattctcagggaaggggtaaagcgggaactgactgataccaggttggagggcagctgtttcagatggacatccgtctgtcccccactaacgagccccccatttctccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416583 - DNA, 3255 bp, Homo sapiens
  misc_feature (3253)..(3253): n is a, c, g, or t
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcaccactcacccacacagcaccatgcaccnca

SEQ ID NO: 416584 - DNA, 1166 bp, Homo sapiens
ttaagatccagtgtccatggaaacattcccacatgccgtgactctggactatatcagtttttggaaagcagggttcctctgcctgctaacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggtccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtacgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 416585 - DNA, 2940 bp, Homo sapiens
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccaccgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctataccttgtgcacctgagggggtagctcatcctccgagccctcttcgggcacgggctcagggtgccttgatgccgactgcccatcttctgcccaccccacagagagagcgt

SEQ ID NO: 416586 - DNA, 2110 bp, Homo sapiens
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaaagcagcaggcaccaagctacaacctcgaaacggcatgctatcgcgcacccgcagcggacgacgtgccataaacacgttggcagaacacgcgccccctagaaacgaaacgcgcaacacaacagaagaggcaccgacggaccaacgaccagacccacaaaccccacacgccataccagtctaaccccactccacatggcacaaagcacacacacgacc

SEQ ID NO: 416587 - DNA, 1875 bp, Homo sapiens
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccaggtactgggagaggagggagccaggtggcctgggatgatgctggaacatacagtgtctttgggaaaaccgcaaaaagacacctctcctgagtca

SEQ ID NO: 416588 - DNA, 1945 bp, Homo sapiens
agcgggcggacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcattccctgagaatcctggttgttagtaaagtgcttatttttgtagttaaaaaaaaaaaaaaaaaaaaaaaaaaaaaaaaaaaaaaaaaccccggggcggcctttattttccgggggcgcggaaaaaaaggggtgtaatataaaagggggcgcaccatggggccatatcgcgttgtgttctccgggacccccagtttttttttgtcacaaggggggaaaatctctggcggcgggtctccccacatatatagagagagagagtcgcagatatatatatatttccagaaaacccgggttac

SEQ ID NO: 416589 - DNA, 793 bp, Homo sapiens
ccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtgggccaggccacaggcgggagcaagccggctagcattcctgggaaaggcatacatctcaccatgatcctgatcccactaggtcctttatcccggaccagcacatggtgttctgccctgagcagctgctccgcgtgatcctcgctcacatccactacatgcctgaccactg

SEQ ID NO: 416590 - DNA, 501 bp, Homo sapiens
gtagagaaaatagcatggactttctcagccaggtacacttaggttcaaattcatctctggcatttagaatttgagtgacctggaggagtaaactcacttcatgtctccaaatcacattgttctcatctctgaaatgaactgctttactgagtagttgtgagcatttagctctatagctgcacataatagaaactttttattttaaaaaaagctcattagttatctaaaaggtaatactctctggaaggggtggttatgaaaatacattgctgcatcggggtgtccagtctggagaggtataagtgttcaaaatacttgaggtttcttatattttgaattaatagctatgggaaatgcctctcttagcttgtaaatgctctggaacttttcttcatagtatctcattcttgagtagtcatgttgggggtagtttttacttataaaagtaatacatgcctgcactccagcctgggcgacagagcgagactccgtctcaaaaaa

SEQ ID NO: 416591 - DNA, 1424 bp, Homo sapiens
cgcctccgcgggaccacagagctgggatagcgcgcgaggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtccc

SEQ ID NO: 416592 - DNA, 750 bp, Homo sapiens
cggagagggagcggtcagagacgattctcatgaagtgcaggttgaggtatgttggctattgtgttacgtatgctgatcgtaatgatatgtagagggtatattgagttttttgttttttgttctatgtttgtgttgttttttgggttgtttttttttttttttattggtctctcatcatctctctcctttttgtttttattagtctccttaaccaaaactgccaagaaaggcttggaattgaaacaaaacctgatagaagaggtaagaggttgttcttttctagagcttgcaattgtttggtttataaaggtaggtataggactgttggccagggataggactgttggccaggggaacatactagtggggaaaaaaaaaaaatctccaagctgccaatccaggcctttttcctccagcagcagcaccagcaaaaacttccatagtgatgatttccagctttgactagctcatactctgtgccctgtcctgcactgtgtttcttatgcgttgttccactccatcctcataacatccctgtgatgtgggtactaggtgatgatgttgctgttttgcatttggggtcactgaagcttacagagatttgttagcctgcccaatgtcaaaaaacaggaggccaggaacggtgggccacgcctgtaatcccagcactttgggaggccaagtgggtcagacagcttgagtctgggagctcaagagcagcctgggcaacatgacaaaacctcatctcta

SEQ ID NO: 416593 - DNA, 2290 bp, Homo sapiens
cgcctccgcgggaccacagagctgggatagcgcgcgaggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416594 - DNA, 1223 bp, Homo sapiens
cgcctccgcgggaccacagagctgggatagcgcgcgaggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtggccaccgcatccagcccacattgttctatttgtatttcatgaaagcagttctgaatgagagtaaatcagcttcagggtgaaca

SEQ ID NO: 416595 - DNA, 2233 bp, Homo sapiens
  misc_feature (236)..(236): n is a, c, g, or t
tcacagtccattaaattcttcccctctcttcttttagcaaacttgtaacatccttttatatcctttcttaacagaaggaaattaagcaaacaaaccagtcttttgccttttctttctctgtttcactcccccttcttattttatttatttattgaattgccatatacggccagttaaaactgctgccggacagtaacatatcccggatgagggtttcgcaaatccaagcgcgacangaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416596 - DNA, 2105 bp, Homo sapiens
cgcctccgcgggaccacagagctgggatagcgcgcgaggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416597 - DNA, 1807 bp, Homo sapiens
ccacccctcgcatcacaccataccgcagcggtcatacggctaggtacagcctgggtttgggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416598 - DNA, 1142 bp, Homo sapiens
  misc_feature (1093)..(1093): n is a, c, g, or t
  misc_feature (1096)..(1096): n is a, c, g, or t
  misc_feature (1102)..(1103): n is a, c, g, or t
cgcctccgcgggaccacagagctgggatagcgcgcgaggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaaggtgatgatggtggccttgggtcggagcccatctgatgaatacaaagacaacctgcaccaggtcagcaaaaggttgaggggtgaggtgggtctcctgttcaccaaccgcacaaaggaggaggtgaatgagtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaatagtnggntatggnntgctgtgtcagaataggagtgggggggaaaaatgacggg

SEQ ID NO: 416599 - DNA, 2165 bp, Homo sapiens
  misc_feature (236)..(236): n is a, c, g, or t
tcacagtccattaaattcttcccctctcttcttttagcaaacttgtaacatccttttatatcctttcttaacagaaggaaattaagcaaacaaaccagtcttttgccttttctttctctgtttcactcccccttcttattttatttatttattgaattgccatatacggccagttaaaactgctgccggacagtaacatatcccggatgagggtttcgcaaatccaagcgcgacangaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccaggtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416600 - DNA, 1800 bp, Homo sapiens
ccagcagccaaggtctgtgatgggggaaggcccagggccacgggacacttgggggagcctgactcatgggctggtggcgtggccaggagcatctcctcctaccacttctcttttcccttaggtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtgtggtgactctgctgtctgactacgaggtgtgcaaggagggcgatgtgctgaccccagagcaggctcgcgtcctgaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416601 - DNA, 1647 bp, Homo sapiens
agtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaagggaaacaccggtgtttccctttgtctcttgcagaagctttttgggtatgagatggctgaattcaaggtgaccatcaaatacatgtgggattcacagtcgggaaggttccagcagatgggagacgacttgccagagagcgcatctgagtccacagaagagtcagactcagaagatgatgactgaaagggactcgggactgaaggtctcctggaagcttctgggtctcactggaccatcaggactgctgccgcccctctggagagagcagctttttatttgtctgtagacagggaacatgatgggcactgacctcctgtaaagaataaaactgtgggccgggcgcggtggctcacgcctggaatcccagcactttgggaagccgaggtgggcagatcataaggtcaggagattaagaccatcctggctaacacggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416602 - DNA, 1271 bp, Homo sapiens
  misc_feature (87)..(87): n is a, c, g, or t
  misc_feature (103)..(103): n is a, c, g, or t
  misc_feature (206)..(206): n is a, c, g, or t
ggcacgaggcaaggattaaaccttcccaggattccgtggacactttagacgctggctctcaactcttgcagtgatgtcacttcttcnccccaaggctgtcttncctggcatcccattcagattccgcagcccctggttttggaaagtgtgtggaggggctaggaaggatacctaattttcctcagcaaaatccctctgccaagggntacccaggactgaggtgaaaccccgtctctactaaaaatagaaaaaaaaactagttgggcatagtggcatgtgcctgtagtcccagctactcaggaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416603 - DNA, 1082 bp, Homo sapiens
gctttcatatgggagaaatttttcctgtagatgtatctgtgatgttggtggggtaggacacttcggctttgatcctgggtgtgtgcagtagtgtagtctctatatgatttctaggctgaggcaggagaatcacttgaacccgggaggtggaggttgccgtgagttgagattggaccactgctctccagcctgggcaacagagtaaaactctgtcccaaaaaaaaaaaaagaatacaaccttgcaggatgtctctcctggagacagcaagagggagaggagggagagggctctttcttagaaaagaggcctttggtgagcccagaagtttgaaaccagcctgggcaattcagcaagatcccgtctctacaaaaaataaaaaaaaattagtcgtggtgccacttgcctgtggtccccactgcttgggaggctgaggtgggagaattgcttaagcctgagagttggaggctcagtgagccatgatcatgccactgcactccagcctgggtggccattgaattctgcgtggattgcctcagtttgccttgtcagccaacttccactggctgccttggcactgccatgacagcacagctccacaccagagctggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416604 - DNA, 661 bp, Homo sapiens
tgggacagagttttactcttgttgccccaggctggaagagcagtggtccaattctcaacttcacggcaaccttccacttcccggggttcaagtgattctcctgcctcagcctcctgagtagctgggactacaggcacattgccactatgcccaactaggtttttttttctatttttagtagagactggggtttctcttcagtcctgggtaccccttggcagagggatttgctgaggaaaattaggtatccttcctagccctccacacacttccaaaccagggctgcggatctgatggatgccaggaagacagccttgggctgagagtgacatcactgcaagagttgagagccagcgtctaaagtgtccacggcatcctgggaggttttatccttggtgactctaatggtagatttttgtccaccttgttctatttgcttttgtttgtttttgatttttctgttttaaaattttaaggagagatggggtttcaccatgttgcccaggctggtctcaaactcctgagctcaagcgatctacccaccttggcctcccaaagtgctgggattataggtgtgagccaccgcatccagcccacattgttctatttgtatttcatgaaagcagttctgaatgagagtaaatcagcttcagggtgaaca

SEQ ID NO: 416605 - DNA, 696 bp, Homo sapiens
  misc_feature (236)..(236): n is a, c, g, or t
tcacagtccattaaattcttcccctctcttcttttagcaaacttgtaacatccttttatatcctttcttaacagaaggaaattaagcaaacaaaccagtcttttgccttttctttctctgtttcactcccccttcttattttatttatttattgaattgccatatacggccagttaaaactgctgccggacagtaacatatcccggatgagggtttcgcaaatccaagcgcgacangaaagtctccttaaccaaaactgccaagaaaggcttggaattgaaacaaaacctgatagaagagcttcggaaatgtgtggacacctacaagtaccttttcatcttctctgtggccaacatgaggaacagcaagctgaaggacatccggaacgcctggaagcacagccggatgttctttggcaaaaacaaggtgatgatggtggccttgggtcggagcccatctgatgaatacaaagacaacctgcaccagaagtctctggccctcacggggtggagctaaggcaaagccgccctctctcccactactcccatgtgacagcctcccccagccattggcaggccggaggctcagggagagcagggcctggcttaaagctctgggttctcccttcacctccggacccaaggaatagcagcttcctgcctcccactccttcctgctatgacaaccaaaaacgtc

SEQ ID NO: 416606 - DNA, 445 bp, Homo sapiens
tgggggagcctgactcatgggctggtggcgtggccaggagcatctcctcctaccacttctcttttcccttaggtggttcacgaaatacacagaaatggactacgcccgagctggtaacaaagcagctttcactgtgagcctggatccagggcccctggagcagttcccccactccatggagccacagctcaggcagctgggcctgcccaccgccctcaagagaggtatgggcagccctggagccaaaaggtcacagcctagagtccaagagcacgggcctgcaagctcatccctttctagctgagcaagttatttctacaagcttccattttctcatgagaaaatggggctaagagtgcatgcctcacagtgggggtgaaagcagacagtaacttacagccaaaatgcagcccttgaggcccatcaggggccttgcgcttgttta

SEQ ID NO: 416607 - DNA, 683 bp, Homo sapiens
aggccctcggtcggacgggacgctcgggattcagggactgcctcggcacacgggaagttgccctacaggcgcgggagaaagcgcaggcggcggcttggcagggagaggcaggctgcagtgcacattgggtcaggcacacgcgaggggcagcccccgagggccgtcccagagtcccccgcgccgccggggtcctaacggggtgcaccgtcttccgccgcacgtggattcagcgcgatgcccaaatccaagcgcgacaagaaagaggtgggcgaagggggagtcgggaccctggggggagctccgtgggctggctacccagcctgcggtgagggcttcggggcggcgggggcgcagattggaacgccaggacatcctcgaggtgttccgctgcctcgctgcgagctggaatgggggcttcggggctgtaaaaccgccagaggtggctgacgcccggtcgggtctggggagcggagactcgttttgcctagtttcaggtgctcttgcaaggccaactgggtcgggaggcagctcctgaacaccgcccccggctatgcctgctgccgtttcggcccacttttcccaacttcggccctttctcatcttcctgcgctcccgccaccctggctgcctttcccttctttcagcacaggtttgttcccgtgtctggcgttgtgtgtctgcgg

SEQ ID NO: 416608 - DNA, 432 bp, Homo sapiens
tgatgcctgtgttagcgagattgtctcttactgtggaactttgtaatgtttagtgatacagtgatgggacctgtaagcttaacctgagcaaatgatctagactaaaatggagattaaaatggattgttactcgtggagaagagggaaaagaagaaaagcaactaattgtcgtgttctttatctcacaatctcacttcaagtatgtggagtaaatattaattctcagagtttaagtaacttttccaagatcacatagctagtgattgaggcagtgtttcaacgcaaggcctgcctctctttccaagagtccgtgttgcctcctaaagaatgaagcagcattctcagagataattcctctaccagctactccgatgggaatttggaacagttctattaactgctacgtgtgatttatacaaattagaagctatt

SEQ ID NO: 416609 - DNA, 361 bp, Homo sapiens
gtgagactccatctcaaacaacaacaaaacaacaacaacaaaatatacatatataatataatatagatatagatatatgttgtgacctaggcacctctcttgctaaccttaagcccagccctgcacccctgcatcatctgaaagatgactactcatctttcaccccactactcacaacagaaacctgggtagcctgagtccttccttgccctcaccctcagactcagtcctttggcaaatcctgtcaactctacctcccaaatagtatccaccatgtccctcagtcacagcccccacataggtccctgccactcaagctctctctggagcaaactactctcccatctgtcccacgcaacag

SEQ ID NO: 416610 - DNA, 114 bp, Homo sapiens
tgaggagggcgtcaggccagtgcaggggtccatctggggtctgggtgctgagtagaatgccccccccatcatccattcaacagagttcttcatggcccaggactggggcccatg

SEQ ID NO: 416611 - DNA, 840 bp, Homo sapiens
atcacactatatgagaatattaaaaatgttgaaataaatttataaataagtgcaaaaccactctatccttagggcaataatcagttgcattccacttaataactaatttttatttttatgatcaataataatgtacatcattttctgttttctggagaaaatgcccatttaaaacacttgtgtttttttcttataatctctcctccttgtgattatactaatctcaaagaaagaatattcttgattaaaaatattgctagtttaataaggtttggcctattgttgagataggtacatgagagtgttaattacaatatagacctcctcaagttggttttacaaatctagaaccatagtgcactttttaacagcttcattgagatatacttgacatatcatataatacttcatattcaaagcagtttttagtatattagtagagtatattttaatacatccatagagacacgctaccatcaccaatttcattacatttttatgaccttgagaagaaacagtgtatcctttagccatcacttctctatccctctatctctactttcatttcagctataaacatcactaatttacattctgtctcaacagatttccctattctagactttcatatgattgtaatcatatagtatgtgaccttttgtgactaaatgatttcacttatgtttttaaaattcattcatgttttggcatgtatcaatgtttccttttattccattgggtgaacataccacattttatttattcatttgtctgttgatggatatgtttgttttgcttttaccttttggttattataaataatatacctataaacatttg

SEQ ID NO: 416612 - DNA, 545 bp, Homo sapiens
  misc_feature (469)..(469): n is a, c, g, or t
  misc_feature (485)..(485): n is a, c, g, or t
  misc_feature (487)..(487): n is a, c, g, or t
  misc_feature (502)..(502): n is a, c, g, or t
  misc_feature (523)..(523): n is a, c, g, or t
gaacaaagaacagagaagctgaacatactgacatatttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaacaaaaaaaaaaaaaaaaaaaaaaaaaaangggcggcccgttttanangatccaagcttacgnacgccgtgcatgcgacgtcanagctttttataggggcccccta

SEQ ID NO: 416613 - DNA, 1679 bp, Homo sapiens
  misc_feature (1603)..(1603): n is a, c, g, or t
  misc_feature (1619)..(1619): n is a, c, g, or t
  misc_feature (1621)..(1621): n is a, c, g, or t
  misc_feature (1636)..(1636): n is a, c, g, or t
  misc_feature (1657)..(1657): n is a, c, g, or t
agcgggcgtaacggttctgctcagctgcctaaaggttctgctcaggtgcctaacggttctgctcagctgcctaacggttttgcgcagccattttctcccgggagaggttggagtgtccaaaagcttggcccgactgagatttctagtcttgtcagggcggatgcagggactgaagaagggcgagggcgagcggcggggactggggaagggcgagcagcgggaggcacgggctctctctagcaggtggctgcagccatggagaggctctctgccgcccctgtcaagggccagacgggcccagagcgcccgagccccttcagtcagctggtctacaccaacaacgactcttacgtgattcaccatggggatctcaggaagatccacaaagctgcctcccggggccaagcctggaagctggagaggatgatgaagaagacgacaatggacctgaacataagagatgcgaagaagaggactgctctatactgggcctgtgccaatggccatgcagaagtagtaacacttctggtagatagaaagtgtcagcttgacgtccttgatggtgaaaacaggaccattctgatgaaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtacagacattaaagtgaagaacaaggctggccacacaccacttttattggccataaggaaaagaagtgagcaaattgtggaatttttactgacaaaaaaatgcaaatgcaaatggagttgataagtttaaatgcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaacaaaaaaaaaaaaaaaaaaaaaaaaaaangggcggcccgttttanangatccaagcttacgnacgccgtgcatgcgacgtcanagctttttataggggcccccta

SEQ ID NO: 416614 - DNA, 1364 bp, Homo sapiens
  misc_feature (1288)..(1288): n is a, c, g, or t
  misc_feature (1304)..(1304): n is a, c, g, or t
  misc_feature (1306)..(1306): n is a, c, g, or t
  misc_feature (1321)..(1321): n is a, c, g, or t
  misc_feature (1342)..(1342): n is a, c, g, or t
tgtaagtcaggttgaaataatgttacaggaagaaattagagatccattttgtctttgttaccagatctatatccctggccctttatatcctgtgtagcaccattttgtaggtagtggaaggtctcatcttattctataaaatcccatgtcatctttcccaagttgtagtgggttccaacttgtggttgtcccctcaagtgattcttttttcctaaaagtaaaaatctcccatgctacttacatctccacctcgagtttctaaaatattttcaaatgctgcatcaccatgaagccattcaatagacttcactaaatctcaagtaagttggttagatttaacagagctaagcctcatccatccctcatcagtcttcacgtataaaagtaaggatttgtgctggcttcagtggtacatatagtaaaattaagacaacgttgagaagatcagcatggtccccgcacaaggatgacatagaaatctgtaaggtgttgcatatttcttgcagtccccaaaaggacattttactactttctaactagctccaaggaaatggtcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaacaaaaaaaaaaaaaaaaaaaaaaaaaaangggcggcccgttttanangatccaagcttacgnacgccgtgcatgcgacgtcanagctttttataggggcccccta

SEQ ID NO: 416615 - DNA, 855 bp, Homo sapiens
  misc_feature (779)..(779): n is a, c, g, or t
  misc_feature (795)..(795): n is a, c, g, or t
  misc_feature (797)..(797): n is a, c, g, or t
  misc_feature (812)..(812): n is a, c, g, or t
  misc_feature (833)..(833): n is a, c, g, or t
tgttgcttgtggatttaatctctaagtgtttacatttaaaggctagcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaacaaaaaaaaaaaaaaaaaaaaaaaaaaangggcggcccgttttanangatccaagcttacgnacgccgtgcatgcgacgtcanagctttttataggggcccccta

SEQ ID NO: 416616 - DNA, 882 bp, Homo sapiens
  misc_feature (806)..(806): n is a, c, g, or t
  misc_feature (822)..(822): n is a, c, g, or t
  misc_feature (824)..(824): n is a, c, g, or t
  misc_feature (839)..(839): n is a, c, g, or t
  misc_feature (860)..(860): n is a, c, g, or t
tgtaataaatttggtaaatttttttatatcagtgttaaaatagtgattttatttatttcatttttatacatagcattcatcaacaacttttggaatataaacaaaagatatctaaaaattctcaaaatagtaatccagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaacaaaaaaaaaaaaaaaaaaaaaaaaaaangggcggcccgttttanangatccaagcttacgnacgccgtgcatgcgacgtcanagctttttataggggcccccta

SEQ ID NO: 416617 - DNA, 835 bp, Homo sapiens
  misc_feature (759)..(759): n is a, c, g, or t
  misc_feature (775)..(775): n is a, c, g, or t
  misc_feature (777)..(777): n is a, c, g, or t
  misc_feature (792)..(792): n is a, c, g, or t
  misc_feature (813)..(813): n is a, c, g, or t
gcaagctgaatgagtagaagttttccaggtaaagagtcagaaggatgatatttagcagaaggaaaatttaaccagactgtgtgtttggcagaaggaacatctgaaggaacacctgacgaggctgcacccttggcggaaagaacacctgacacggctgaaagcttggtggaaagaacacctgacgaataggatacagtgaattcctcttcaaagattttagcctgtaaacatcctttaaaattcaagaggggggaagattaagtacaatgagttctgagttcctcatcaaagaacaaatatgtcagtatgttcagcttctccgttctttgttctccgttttaaagtttaacttcctcgttcgttatgcctccttgcccctagtttcattaaacaacccccttctagcctctaacacctgctttgtctttagtcattcttagtaacctgctctgtccttagtcatccttagacacctgctctgtaactgtctttcccgctgaaactactcaccctgccactccagctcatacccctgccctctttaaatagccaatctgaattggcttagagtgtgcagtccaaccctatccaatagggaaaagacacaacagtagggactagctgcgttagaaataagaacactttcccctcccttgtccggtgtgatcttgccattgctccatctgcaagaccactcttccatagaagtaaatttgccttgctgtaaaaacaaaaaaaaaaaaaaaaaaaaaaaaaaangggcggcccgttttanangatccaagcttacgnacgccgtgcatgcgacgtcanagctttttataggggcccccta

SEQ ID NO: 416618 - DNA, 1053 bp, Homo sapiens
agcgggcgtaacggttctgctcagctgcctaaaggttctgctcaggtgcctaacggttctgctcagctgcctaacggttttgcgcagccattttctcccgggagaggttggagtgtccaaaagcttggcccgactgagatttctagtcttgtcagggcggatgcagggactgaagaagggcgagggcgagcggcggggactggggaagggcgagcagcgggaggcacgggctctctctagcaggtggctgcagccatggagaggctctctgccgcccctgtcaagggccagacgggcccagagcgcccgagccccttcagtcagctggtctacaccaacaacgactcttacgtgattcaccatggggatctcaggaagatccacaaagctgcctcccggggccaagcctggaagctggagaggatgatgaagaagacgacaatggacctgaacataagagatgcgaagaagaggactgctctatactgggcctgtgccaatggccatgcagaagtagtaacacttctggtagatagaaagtgtcagcttgacgtccttgatggtgaaaacaggaccattctgatgaaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtacagacattaaagtgaagaacaaggtagacattaaccaatgttattttcaaaatatttgaaatccatttgttttaacattaacatatgtaaattgttttatatttggaagctcaaacattcctatttttctatgaaaatagtttgacaaaacttaattgtctaggattttgctttaaatattaatatttttacaagaactattagtatggcttttctgtgcattatgataaatatttaaatttgttaaaggtaaaacattttcaaatattctttcccacccaagtttttttttttctttccagttagtgtaaaac

SEQ ID NO: 416619 - DNA, 847 bp, Homo sapiens
agcgggcgtaacggttctgctcagctgcctaaaggttctgctcaggtgcctaacggttctgctcagctgcctaacggttttgcgcagccattttctcccgggagaggttggagtgtccaaaagcttggcccgactgagatttctagtcttgtcagggcggatgcagggactgaagaagggcgagggcgagcggcggggactggggaagggcgagcagcgggaggcacgggctctctctagcaggtggctgcagccatggagaggctctctgccgcccctgtcaagggccagacgggcccagagcgcccgagccccttcagtcagctggtctacaccaacaacgactcttacgtgattcaccatggggatctcaggaagatccacaaagctgcctcccggggccaagcctggaagctggagaggatgatgaagaagacgacaatggacctgaacataagagatgcgaagaagaggctctgcaatgccagagggaggcttgtgcaaatattctcatagattctggtgctgatccaaatattgtagatgtgtatggcaacacagctgtccattatgctgttaacagtgagaatttgtcagtggtggcaaaattgctgtcctgtggtacagacattaaagtgaagaacaaggctggccacacaccacttttattggccataaggaaaagaagtgagcaaattgtggaatttttactgacaaaaaaatgcaaatgcaaatggagttgataagtttaaatgcacagccctcatgcttgccatatgtcatggatcatcagagatagttggcacggttcttcagcaaaatgttgacatctgtgctgaagctacat

SEQ ID NO: 416620 - DNA, 459 bp, Homo sapiens
ctgactttcttatttatgataagagaaagaaggaaataacaccgttgaaattgggatttataaaagatagtgtcatagtaattcccagtattatgatatatgactggatagagtccaagtgtgacaaacatatttaggttcttagaagtgtaacacatttcgaggcctttgttcagtttctgaatgttcagggggacatatgagacatggaacaattctctgtagttcaggactgtccttgcaagacatccagtgtacctggtcctgtccctgcccgttaaatgcctgcggcattactttccagagcctggccaataataatcaccacgccagccataactagttctttctcagtctgctatgatagatggcaccaggttattagattccttgggattccaaaatgcacgctgaccccaccctttatttgggtaggatgttcattctgtcttttaaggc

SEQ ID NO: 416621 - DNA, 228 bp, Homo sapiens
aatattttttactttgtgctctagccatcagtgagaaaagtatgtataatggtctctggtagatttttacagttttggtatatccacttgttcccaattttaggttttagccttttttttttaaacagtttttcacatgacaccattacttttttctttatcattctcagaatatgttaaaggataccagcatcgtaaagcttgaaacatactgtttaaaatattgat

SEQ ID NO: 416622 - DNA, 579 bp, Homo sapiens
tagccactaaaaaggctaatttttggggggaaaccgtctgctctgtcgcccagcctggaatgcagtggcacgatttcggcgcactgcagcctccgcctttctcaattctcgtgcctcagccgcgccatcatgcccggctaattttttgtattttagtagaggtggggttttgtcatgttggccaggctctaccaaaaatacaaaattagctgggcgtggtggcgcgcgcctgagcgagagactccatctccaaaaaaaaaaaaaaaagtaaagaggtcgaagctgtctaagcggacgctgcggtggactagcggtcaagcttgcctgcgagcggctcacctgagtcacccccaaaaccggcctccagcagcatacccgaccctgcagtaccccctcccacgcagcctgcgatcgggacgcctgcaggaggcgccagagtcttcgcgggggttgcaatcccgcgcaagggcccccggctcccaaggcatccgcaaccttccgatcccccgggaaggccctgcacgtctcggccgctccctgccagcagcccgccccgccactacactccgccgcggccgc

SEQ ID NO: 416623 - DNA, 606 bp, Homo sapiens
gaccacaggaaatttgaggttatcagagtttacatgtgaaccaaattatacctcccctctcctaagaagagctggcctccctctgtacaccctcttcctccctgcagaggcttgcatcgatctcggccaatccgggcactctgtaggccttttcctctttgctttgtcctcagtgtcctagccactcaccgtcacagcagtgttcttctgtggtcataaatcttttcttaacctcctcagccttttattctctaggtcaaataaccccagctccttttatcttttcttagtatggcctgtatcccaaccccttgattattttattgctctcctctggactgcctccaattcttcgcctcagagttcaaaactggccacactattcttaaaagtctgagcaaggccgggtgcgatggctcacgcctgtaatcttagcactttgggaggccgaggcgggcagatcacgaggtcaagagatcgagaccatcctggccaacaccaacatggtgaaaccctgtctctactaaaaatacaaaaataaattaactgggcatgatggcgtgcacctgtaatctcagctaagcgggaagctgaggcaggagtatc

SEQ ID NO: 416624 - DNA, 791 bp, Homo sapiens
taattagactgagtctcgctctgttgcccaggcaagtgtggtggtataatctcggctcactgcaacctccatctcctggtttcaagctattctcttgcctcagactcccacgtagctgggattacaggtgcgtgccaccacacccagctaattgtttgtgtttttagtaggaatggggtttcaccatgttggccaggctggtcttgaactcctgacctcaagtgatacacccacctcagcctctggaagtgctgggattacaggcgtgagcaagccactacacccagcccaggatgaattttaaaaactttaaaaatgttcacatagaaatgttatttttgctttattattttatgacacaaggtatctaagctctctctttactgaggacaaaaaatagtttaaaaaatatatacaatatattacccacatgttccatctttactaattacaaagagtttaattttagcattgttatcctgtaggaagtcatttcccattgttacagtgtatggcatgcatttatctttagcaaatatcctagtattttatatcttgtgtagaaatatgctttggtgtgattatgagatggtttcttgattaatactcttagaaaactgacttgagggcggttggtgggtgaggggagagaaagcattaggacaaatagctaacatatatggggcttaaaacctagataatgggttgataggtgcaacaaacgaccatggcacacatctacttatgtaacaaacctccacactctgcacctgtatcctggaactcaaaaa

SEQ ID NO: 416625 - DNA, 2415 bp, Homo sapiens
tggcgaattcggcacgagggagacaggaaggtggcaaaggaaggagcccatttgcatgacaataattgagccaagaatagaaagccacagggatgcaagggtgaggctggcggctgagctgggctaaacctcacaaatcagactacccagctctgctccgcaggggaagggagactgagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416626 - DNA, 2050 bp, Homo sapiens
tggcgaattcggcacgagggagacaggaaggtggcaaaggaaggagcccatttgcatgacaataattgagccaagaatagaaagccacagggatgcaagggtgaggctggcggctgagctgggctaaacctcacaaatcagactacccagctctgctccgcaggggaagggagactgagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacttggaattaggatcctcccaaagtgctgggactacagacgagcttgagccaccattgcccggctgtctattt

SEQ ID NO: 416627 - DNA, 1699 bp, Homo sapiens
tggcgaattcggcacgagggagacaggaaggtggcaaaggaaggagcccatttgcatgacaataattgagccaagaatagaaagccacagggatgcaagggtgaggctggcggctgagctgggctaaacctcacaaatcagactacccagctctgctccgcaggggaagggagactgagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttttgtgtgtattgccaacagttttgtatggtttacttccacatagctgacttctttcctatgctctttgaacagaaaagaagcccagaaatgtttctgcggatcagccaattgccggggttacctgggaggagaaaacagagtcagcatcagagcagcaggagggaaaatgaagaaggaacgatctcgtaagaaggattcagtaagtttgcatttttctttcaactttcacaat

SEQ ID NO: 416628 - DNA, 2363 bp, Homo sapiens
tggcgaattcggcacgagggagacaggaaggtggcaaaggaaggagcccatttgcatgacaataattgagccaagaatagaaagccacagggatgcaagggtgaggctggcggctgagctgggctaaacctcacaaatcagactacccagctctgctccgcaggggaagggagactgagccctgggccaggcttggcagagagggaagcgggaggacacgaccccagggcattgtgggaacactggccaggctggactttgccttcctcctcgtcctttagccgggagcctgtctttgcttgcctttgcctttgaggctctgtggctgtggggctgagtggcatcatggcggctcagaaagatctctgggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416629 - DNA, 2134 bp, Homo sapiens
agtcagcatcagtttccttgttcataaaatgaaggggctggagtagttgaactggaaggttttttctaattttgcttctttgtgaatctaagtgaggtgagattgcagcaggatggttgaagactagctaacaaaagaacttctggatgtgaacaacgttagcaaaaaggaagcctaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416630 - DNA, 2006 bp, Homo sapiens
gcaacaaccacagataccaaggggagtggcagcaggaaagagggagagggatccttgggtaggagactctcagaagcgcacaatcctcctctttgccaggaggacaggaatttggacgggctttggaactggacctggctctaaatctcagctctgacacgctcagctgtgtggtttggaacgagctgttgaacctctggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416631 - DNA, 2082 bp, Homo sapiens
agtcagcatcagtttccttgttcataaaatgaaggggctggagtagttgaactggaaggttttttctaattttgcttctttgtgaatctaagtgaggtgagattgcagcaggatggttgaagactagctaacaaaagaacttctggatgtgaacaacgttagcaaaaaggaagcctaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416632 - DNA, 2052 bp, Homo sapiens
agtcagcatcagtttccttgttcataaaatgaaggggctggagtagttgaactggaaggttttttctaattttgcttctttgtgaatctaagtgagttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416633 - DNA, 2228 bp, Homo sapiens
gtgggaactgtagttccatgtgcgtgcgatgcactctatgggcccagctgtgctgctgtgttaacctggaggcattatggaacaggaggccctgagtacctgcggtggggtgaggccagagtgagctccagctcagatgatcagggagaaggctgcaccagtctcattggattcttcacaccagctggtgctgaaggttcaggggttgaagttgaaagaagcccgtggggtcctccataaaggactcaaggtgctggccttccaacagcctgttctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416634 - DNA, 2279 bp, Homo sapiens
tgaatcaccggcctggcagccccaagcctctgtggcctttgggttagatgaaggggcttgttttgtgcaccaggaccaaagttacctccctgactttgtgacctttgccctgtggttacttttgtctgctgcatctgggaggagatgaagttggagagcttgactgtagatggaggggccctaagcccagacccctgggctaccctgatgctgagagctggaatcttgctccattgcccaggctggagtacaatggtgtgattatagctcactgcagcctcaaactcctgggctcaagtgaccctcctgcctcagcctcccaattctttctaccacactcccgaggaagctcccatggacaaagccggataatccgaaaggcgtacctggaagacttttacacccggatgatgcatgagtgctatcagatatgggcccagctggagcacgaggctggaacccaattgcacaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416635 - DNA, 1865 bp, Homo sapiens
gtggaaccatcagttgttcaacaggcacgttacagaggaggaatctgggcccagagaggcagactggattactgctgctgggaatgaaagagaatcaagaattaaagacaatccaggccaatctgtcgaggcagagggtagaacaccagtgtctttcatctgaggaactgaagcaacgtttcccaaatattcggttgcccaggggagaagtggggctcttggacaattccggaggagttatctatgcatataaggccctcagagccctgcaggatgcaattcgacagctaggaggcatagtgcgtgacggagagaaggtggtggagataaacccagggctactggtcacggtgaaaaccacctccaggagctaccaagctaagagcttggtcatcacagcaggtccttggaccaaccagctcctccgtcccctgggcattgagatgcctctccagaccctgcggatcaacgtgtgttactggcgagagatggttcctgggagctatggtgtgtcccaggcctttccgtgcttcctgtggctgggcttgtgtccccaccacatctacggactgcccacaggagagtacccagggctgatgaaggtcagctatcaccacggcaaccacgcagaccctgaggagcgggactgccccacagcacgcacagacatcggagacgtccagatcctgagcagctttgtcagagatcacttacctgatctgaagcccgagcctgctgtcattgagagctgcatgtacacgaatacccctgatgagcagttcattctcgatcgccacccaaagtatgacaacattgtcattggtgctggattctctgggcacgggttcaagctggcccctgtggtggggaagatcctgtatgaattaagcatgaaattaacaccatcttatgacttggcaccttttcgaatcagccgtttcccaagcctgggcaaagcccacctttgacctctggccagaagcctcccttctgtgcacaggagccagtttcacagatggagaagatgtctcagatgaagggagtgtccctgagatatcatccttttcttctgcctcgcctgaatcccccataaacaccagatgattgagtctaccttctttccttggcccgctccctttttcttctgcctcacttgaatcccccgtaaacaccagacgattgagtctaccttcttttcttggccacctccccattcacaactactttctcgctcccagaaggttgatcagatattctacaatcacagagtagcaaggacgtttgagatgggtatatcagtaagaagagggcacaagaactggctctggagaccaaagcagttgttaaaaattctctttgctgggggccgggtgtggtggctcacacctgtaatctcggcactttggggggctgagacaggcggatcacctgaggccaggaattcaagaccagcctggccaacatggtgaaaccctatctccactaaaaatacaaaattagctgggtgtggtggcgcatgcctgtaatcccagctacttgggagactgaggcaagagaatcacttgaacccgggaggtggaggtggcagtgagccgagattgcgccattgcactccagcctgggcaaaaagagtgagactctgtctcaaaaaaaaaacaaaacaaaaaaaacctctttgctggtatatttgaagagcttgggatggatttgactaaatctgccccgaggagggtgaacaaggtgatctcagagatcactactgctcttggagttccttctcctaaagctaaggccagcctccatcacaaatgcccataaaatctggctcgtctttgatgaacaataaatatttgttgaacaaataa

SEQ ID NO: 416636 - DNA, 727 bp, Homo sapiens
acatcagagttctactcctaataacaaatgtttaatttttaatgaaatattcaagcctcatgttttccaacagaacacaaatgtgacatgacgcttctccacggaagcaacaagtgtggggttaagcagggagaacgaaggtggtaacagaggccggtgtcaagggagtgtgaaggtttcagagagtgattcatcctaaatcctgcttctccctatatggcatgtaaacccttccagattcctggaaactacatcctggttgtttatctcagcaaggtgagccgtcgaccgaaggctcgtgaccactatctcgaaaagcaggctttaagcagtcttgaatttgaatctgagctcctcacttcttggcttaagcatgtctatgaatcttctgagaccatctcctcatctgcaaaattggggacaagacttgctgcttatcaatctttgcagtagagggaattctgtggcaggcagctatcagacttgaactgcaataccggctcttcctggctttccagcttgtgggccccgcctccataatcatgtgaaccatttccttaaaatcaatcaccccctgtgacttatttatatatatatgtatatgatctgtttctctggggaaccctgactaatacaatgatctaaaccaattttctgttttgattttagctttgtattacggcaatttgctatctatccaaaaatcaataaaatagaattaaaaact

SEQ ID NO: 416637 - DNA, 3915 bp, Homo sapiens
acgaccgggagggcggggcccgtctggggcgccggcgggtgcgtttgaatctggtccgagcgcgggaaacggcgggtccccgagcccaggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaagggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416638 - DNA, 3981 bp, Homo sapiens
taccagacctcctgtgcgaagagtaacctgctcttcggactgataactggatggaatggcctttagaaagggagcatcttcagaatctgcagctgggatcagattgttcttttgttgaatcaactcagctctgccgagccagcatcttgctaagggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaagggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416639 - DNA, 4220 bp, Homo sapiens
gaattcaaaggaatcctgaataccctacgtccaggtttgccagtttttaccacttgccacattttctttatcatcctttgtatttacatttttttgaatcacttgagtcagttgtaggcattgtgcctctttatctctaaacatttcagttcgtatttttctaaaagatattctgttatataatcacattaaaatcctcaaaatcaggaaatttaacattgtggataatcctgttaaataaccctctgcagcctatgtcctctcctcttgaatctggattgggcttgtgctgctttgacggacggaatattgaggaagtggccttcagaaagtttggcagcttctacttcctctcggagcccgtggttgtcatgtaagaagtgcaggatcaccctctgctggagagagagaccacacacaaaggctggaggatgagactgcagagggagacctcattagtgggcaccaaagtgccagacatccaacacccagctgccaccttaagcacagaaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaagggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416640 - DNA, 3649 bp, Homo sapiens
acgaccgggagggcggggcccgtctggggcgccggcgggtgcgtttgaatctggtccgagcgcgggaaacggcgggtccccgagcccaggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaagggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcgggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtat

SEQ ID NO: 416641 - DNA, 3741 bp, Homo sapiens
acgaccgggagggcggggcccgtctggggcgccggcgggtgcgtttgaatctggtccgagcgcgggaaacggcgggtccccgagcccaggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaagggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416642 - DNA, 2233 bp, Homo sapiens
ggcaggacgaggccgggcggtgaatcggccgaggatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416643 - DNA, 772 bp, Homo sapiens
cttctagctcggtacccatcttccctctctcacgcagaactgtgggtgctggaaaggaagagcacacgtcctgtttgctcaccagcatagcacactgcccagtgagcacgtttcattgcctggcagtgcttggtgtccacggtcaacccaagcctgtgctccagtgccatgtgtcctgactgctgtggggattctgactccattttacatacaagaaacaattaatgaaacatctatagattatttcaactttgtttttaaatgcatggttgcaaaccatttttagattatatttttgaaaatgtacatttggataatttggtcacttttttctgtagctaaatatttctttatttgtgtttcagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416644 - DNA, 992 bp, Homo sapiens
gttaaatttatttagcataaaagcacattatttacagtagatgataacaagataaagactttttgatgaaagacttattgagtaatatgtctgtttttctttatttttgtctcactgaataaacactttcgtttatcttttttttttttttgtcatattgagacaggatgtcgctctgtcacccaggctggagtgccatgatacatggctcactacagcctcaaattcctgggctgaagtgatcctcctgcctcagtctcccaagtagctgggactacaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416645 - DNA, 453 bp, Homo sapiens
atgatcgcccgcacgcatgtcccctgaaggaggaggaagagggcttatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416646 - DNA, 647 bp, Homo sapiens
cttctagctcggtacccatcttccctctctcacgcagaactgtgggtgctggaaaggaagagcacacgtcctgtttgctcaccagcatagcacactgcccagtgagcacgtttcattgcctggcagtgcttggtgtccacggtcaacccaagcctgtgctccagtgccatgtgtcctgactgctgtggggattctgactccattttacatacaagaaacaattaatgaaacatctatagattatttcaactttgtttttaaatgcatggttgcaaaccatttttagattatatttttgaaaatgtacatttggataatttggtcacttttttctgtagctaaatatttctttatttgtgtttcagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtat

SEQ ID NO: 416647 - DNA, 293 bp, Homo sapiens
gatgattgttaccatcttttcattatgtaatgctcttctttatctctgataattcttcttactgtgaattctgctctgcctgaaattaatactactactcctgctttgttttgattagaataagcatggtatatctttttattcatttcctttttttttttttttccaagatatgaggacttgctgtgttgcccaggctgggctctaactcctggactcctggactcaatctatccttctgcctcagtcccaattggctaggactgcaggcacacaccaccagacccagctaa

SEQ ID NO: 416648 - DNA, 415 bp, Homo sapiens
ccaggtatgaatggtgtagaaatccatgattccaagaaaaaacacttttctagcaaacctggttgtttttaaaatgacttttatatatgtaatattgcttggaaactatgagtaataaagcaatgacaacatcccatttgtttatttgaaagtattaggggcccggcgcagtggcacacgcctgtaatcccagcactttgggaggctgaggcaggcagatagatcacttgaggtcaggagttcaagaccagcctagacaacatggtgaaaccccgtctctaccaaaaatacaaaattagctgggtgtggtggtgaatgcctgtaatcccagctactcaggaagcagaggttgcagtgagctgacgtcgcgtcactgcaccccagcctgggcgacagagcaagactctgtctcaaa

SEQ ID NO: 416649 - DNA, 2339 bp, Homo sapiens
aggtaaggagggcggagggacccagtagtggttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416650 - DNA, 3979 bp, Homo sapiens
acgaccgggagggcggggcccgtctggggcgccggcgggtgcgtttgaatctggtccgagcgcgggaaacggcgggtccccgagcccaggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaagggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcggctgctttattctgttcagaggcctcttcatgagttcattactgctgttcagtctcggcacacagacacccctgtgcaccggggtgtactttctactctgatcgctgggcctgtggttgagataagtcaccagctacggaaggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatatgaggacttgctgtgttgcccaggctgggctctaactcctggactcctggactcaatctatccttctgcctcagtcccaattggctaggactgcaggcacacaccaccagacccagctaatgtaatttctatctatatgtgtctttatatttaaagtggtttttttatagacagtatataaatgggtcatgttttttgatcttctctgacaatctgtcttaaaattggtgcatatgtaccatattcaaagtgattattgatatagttggattaatatccaccatatttgttattgtcttctatttgttccccttgttatttgttcctatttctgtcttccactccttttctgtcttttgtggttttaactgaacattttatgatgccgttttctttcctagcatatcagttatacttttttttttttaaacctttcttagtggtttctttagagttggaatttttatt

SEQ ID NO: 416651 - DNA, 3854 bp, Homo sapiens
acgaccgggagggcggggcccgtctggggcgccggcgggtgcgtttgaatctggtccgagcgcgggaaacggcgggtccccgagcccaggttacaaaataaatgccatttgaacagtgccatctgtcatggaaaaacgtgagacgtttgtacaagccgtgtctaaggagctggttggagagtttttgcaatttgttcaacttgataaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatgagaaaaagcatagaaataatttatgcaattacatctgtgattcttgcttctgtgtctgtaataaatgaaagtgagaactacgaagccctactggaatgtgttattatattaaatggtattttatatgcattacctgagtctgaacgaaaactacagagttctattcaggatttgtgtgttacctggtgggagaaaggcctgcctgccaagggaagacacaggaaagacagcctttgtcatgttactaaggaggagtctggagactaagacaggtgcagacgtatgtcggctttggcgtatccatcaagctttatattgctttgattatgatttggaggaaagtggagaaattaaagatatgttacttgagtgcttcataaatattaattatatcaagaaagaagagggaagaagatttcttagttgtctcttcaactggaatatcaacttcatcaaaatgatccacgggaccattaaaaaccagttacagggattacaaaagtctttgatggtatacattgcagaaatttatttcagagcttggaaaaaggcttcagggaaaatactggaggcgattgaaaatgattgcatccaggacttcatgttccacgggatacaccttccgaggaggtctccagtgcattccaaagtgcgggaggttctgagttactttcaccatcaaaagaaagttcggcagggagtggaagagatgctttatagattatataagcccatcctttggagaggattaaaggccagaaactctgaagttcgatcaaatgctgcattgttgtttgttgaagcatttcctattagggatccaaaccttcatgctattgaaatggatagtgaaatccagaaacagtttgaagagctctatagccttttagaagatccttacccgatggtccgttccacagggatccttggtgtttgtaaaataacttctaagtactgggaaatgatgcccccgaccattcttattgacctcctgaagaaggtgactggggaactggcatttgacacgagctcagctgatgttcgttgttctgtctttaagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacatagcaaagctgattcacgttattcgtcattgcttaaatgcctgtatccagagggcagtgagagagcctccagaggacgaggaggaagaggacggaagggagaaggagaatgtgactgttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggatgatcgctgcaagatccctttattcatgctaatgtcctttatgccggcctctgctgtccccccattcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggcagatctggagtcacttctgcagacaccgggtgggaagcctcgtggcttcagtgaagcagctgccccgcgagcctttggtctccactgtcgcctgagcatccatcttcagcacaaggtgtgcctgctcctggccctctattaggatgatacacagtgctctttttgttactgatttatcttcttgtttttggacagttctgctcagaaggaaaggtgtatttgtccatgttggaagacactggcttttggttagaaagcaaaattttatcttttattcaagatcaagaagaagactacctgaagcttcatagggtcatttatcagcaaattatccagacctacctgactgtgtgtaaagatgttgttatggtaggccttggtgaccatcagtttcagatgcaactcttacagcggagtcttggaatcatgcaaacagtgaagggatttttttatgtttcattacttcttgacattctgaaagagataactggaagttccttgattcagaaaacagattcagatgaagaagttgcaatgctgttggacacagtccagaaagtatttcagaaaatgttggaatgtattgcacggagcttcaggaagcagccggaagaaggcctgcgggtttctgacgtagaagagcttacccctccagagcatctttctgatcttccaccattttcaaggtgtttaataggaataataataaagtcttcgaatgtggtcaggtcatttttggatgaattaaaggcatgtgtggcttctaatgatattgaaggcattgtgtgcctcacggctgctgtgcatattatcctggttattaatgcaggtaaacataaaagctcaaaagtgagggaggttgcagccactgttcacagaaaactaaagacattcatggaaattactttggaagaggatagcattgaaagatttctctatgaatcatcatcaagaactctgggagaacttttgaattcataaccaagccaacatctccagacatgtaaaaatagggaaaagtgattcaaattgaaatgcctgtgtattttcctattgtttttaatgttaataacccatataatagggaaagggtgggatttttttgtgggaatgtgggaaggtgggggttatggaggagataactcaaaacttcttcaattttgcctagtgcctgcgtaaataatatatttaatataaaggactccaggtatgaatggtgtagaaatccatgattccaagaaaaaacacttttctagcaaacctggttgtttttaaaatgacttttatatatgtaatattgcttggaaactatgagtaataaagcaatgacaacatc

SEQ ID NO: 416652 - DNA, 533 bp, Homo sapiens
tggtgccaactgttctagagtcaaataccaaaagaagtgaagtttcccgactggatgcgacaagttgcaggtttgcagacctgattctgagatggccctcaagattcccgtctttggcacccctctccatttttgtgggtgggatctgtgactataatgggatcactgctcccttgattaggtgctgttatatgagactccatctgagcagactgtctagtaattcacagctggccccaaagaagcaaatggccttgttatgaactacttacctcaggtcctagccgcatggcccccttcaaaggctaagagtgactctcaccaaccagcaaagacaaaataggatgtcatttctacagctacaaggaactggtttctgcccacaaccccaagctccagaaggaattcagcccagcaaacacccggatttcagtctgtaagactctgagcagagaccccagccacactatgcctggattcctgactccttgtaactgtgagataataaaaggctaatgttttatgtcaataaa

SEQ ID NO: 416653 - DNA, 138 bp, Homo sapiens
ggtcaaggaagaaattaaggaggaaatcacaaaatttcttgaaacaaataaaaatcaaaacatagcacaccacaacctatgagatacagcaaaagcagtgctaagaggaaagtgtatagcaataaatgcttacgtcaa

SEQ ID NO: 416654 - DNA, 468 bp, Homo sapiens
ataattttcctttcttgtattatagttgcaaggttttggtagcaaggtaaggctaaccttgtcaaaaaaaaaaagttagaaaatagtcccttgtttttattctcttggagaataaaattggtattacttcttccttaaatgtttggaagaatttcctcttgaagttatctggtgttggggttttctttgtgtaaaagttttaaataaccaattcaattccattaattattcagattttctaattatttttctttcagcttggtaagttgtactttttaaggaatttattcattttattcaaaatgtcaaatgtatttgcataaattttgtcacacacatattcccttatcttttttatgcctgtaggacctgtagtgagttcctcttgtttatttcatatattggtaatgtgtgttttctctttcttttttaaaaattttctttattccttacctggagcactaaaaa

SEQ ID NO: 416655 - DNA, 1038 bp, Homo sapiens
cggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgtt

SEQ ID NO: 416656 - DNA, 1493 bp, Homo sapiens
cggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgtt

SEQ ID NO: 416657 - DNA, 1346 bp, Homo sapiens
cggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacaaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgtt

SEQ ID NO: 416658 - DNA, 1182 bp, Homo sapiens
cggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcgcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatc

SEQ ID NO: 416659 - DNA, 143 bp, Homo sapiens
gtttccagaaggactggggagaaacaaagaatggcccccaatgctggggtctggggttattttgagttaaagggactcggagctactgaatgtcttccacattcaagtcctagaactctttccttgagatattccactttaca

SEQ ID NO: 416660 - DNA, 577 bp, Homo sapiens
  misc_feature (519)..(519): n is a, c, g, or t
aggcgcctgccaccacgcctggctaattttagaattttagtagagatgaggttttgacatgttggccaggctggtctcgaactcctgacctcaggtgatccgcccactttggcctccctaagtgctggcattacaggcctgagccaccacgcctggcctacatgatgtgtttctgtcctgcctgacctacatggtgtgtttctgccctgcgtattacacacacacacacacacatgtgcgtgcacacacacttctaaggacgtggccccatctggctttgtctctccagttgtccttgccctgcccccctccccagaggtgctgcccagtgctggtgtggccacacacggctacatcattgtgcaggcagagctccctgcctgcccagcctcagggctctgcatgctcacacctagatcctcatcttcctccatgtctctgcccagcatagccccgagcccctggaagctggtacccctcagtgtgctcacacgtggcaaggccgaggtggccccaggnagggcattaaccaggcacaaaccatgcacgctggcatgggtgcggggatcacacgaat

SEQ ID NO: 416661 - DNA, 2169 bp, Homo sapiens
cccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccggtgagggcgggacagtctggtctgctcgtgaatatttataaaccggctcccccgcaggcgccacctgtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtggaagtacctggacgtccattccatgcaccagctggagaagaccaccaatgctgagatgagggagtagggactgaggggggcgtgggaagagctcttggcaaaggctgaggggtcaggttgggaaaacatgaggaatggctgactccaaagcatgtggtgggtgtagggtgatgaaaggaggcccagttgtcactcactcctctctccctcccaagggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgctcatggtcataaacagctgttgagtgaagtgaatgaatggataccagagagggcctcactgctgcatcttgctttccctaccagcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggtaagggagagtgccagggcagggctgggctgggccaggcctggggccacagtctcttcctgcttctggtttgcagagaaagaagaaagcaaggagatggaggagcaggcagttaccccgcagaaagaggaactagagacagtggccccaccagagccagagccaagccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416662 - DNA, 641 bp, Homo sapiens
agccaatgacaataacagccagcacatacttggcaataggtgtgcagtgcatgccctgctctaagcattttacataaattaactcatttaatcctccctcaatcctatgtgctaggtatcactatccacatttcatacaaggaaactgaggcacagataggttaaataacctgcctaaggtcacacagctactgagtagggatcagaatttgaagctgcaaagtccagcatagccaccctacccaactacctctcacacaagggcttgctaacatttcctaaagggaaacaacattgctacctctatatccccaccaggggaaatttggggactgtttgcccaactagggaccatccccccattgccagacagcatctctcctcaccctgccccttcttccctgcccctgcaggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416663 - DNA, 1541 bp, Homo sapiens
cccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacggagaaagaagaaagcaaggagatggaggagcaggcagttaccccgcagaaagaggaactagagacagtggccccaccagagccagagccaagccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416664 - DNA, 1766 bp, Homo sapiens
cccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccggtgagggcgggacagtctggtctgctcgtgaatatttataaaccggctcccccgcaggcgccacctgtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416665 - DNA, 1379 bp, Homo sapiens
attacactgaatatttgcgttctttattgtctccccaacagtcctgtctgtggccagggcatccccattttacagatgagactgaggcctggagatgcaattactccaggtgactggaagttggctttccagcctctccagtccaaagaggaggcagtgtgagaaaaaaagagccaaagacagaatgtaaatggagtctcatggccgctaaggagtattgtacagagggggacactgagggccacagggagtacttgaccaaggtcatacaaggtagtggcagagcagaaaaaagaattcaagattcctaaccctaggctttagaaatggagaggctcataagagttcatttaggcccagagagttaacgatttgcatagtcacacagcaagctggcaaaagagcccagcttcacgccggtggccaactcccagtctcacgcactagctgtcacagccctgtcatgataggtaacggccaccaataactttttcttttactataacaggaagtacctggacgtccattccatgcaccagctggagaagaccaccaatgctgagatgagggagtagggactgaggggggcgtgggaagagctcttggcaaaggctgaggggtcaggttgggaaaacatgaggaatggctgactccaaagcatgtggtgggtgtagggtgatgaaaggaggcccagttgtcactcactcctctctccctcccaagggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416666 - DNA, 1660 bp, Homo sapiens
cccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccggtgagggcgggacagtctggtctgctcgtgaatatttataaaccggctcccccgcaggcgccacctgtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtggaagtacctggacgtccattccatgcaccagctggagaagaccaccaatgctgagatgagggagtagggactgaggggggcgtgggaagagctcttggcaaaggctgaggggtcaggttgggaaaacatgaggaatggctgactccaaagcatgtggtgggtgtagggtgatgaaaggaggcccagttgtcactcactcctctctccctcccaagggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416667 - DNA, 628 bp, Homo sapiens
cgccggtggccaactcccagtctcacgcactagctgtcacagccctgtcatgataggtaacggccaccaataactttttcttttactataacaggaagtacctggacgtccattccatgcaccagctggagaagaccaccaatgctgagatgagggagtagggactgaggggggcgtgggaagagctcttggcaaaggctgaggggtcaggttgggaaaacatgaggaatggctgactccaaagcatgtggtgggtgtagggtgatgaaaggaggcccagttgtcactcactcctctctccctcccaagggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggtgagagggggcagctaccaggtttgagccccagggagaagaggaaccgggcctggcacaagtgaccatgggaagcagaagcaggggatttctgcctggaatatgtcattattagtagcatcatcatacacaagccatcagctttccaa

SEQ ID NO: 416668 - DNA, 1352 bp, Homo sapiens
  misc_feature (974)..(974): n is a, c, g, or t
cccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcatttttcttgcccggccaggcaaggggccttttcttccaacttggaggcaaggaacgttcaagctggggcttgggtggccccttggattccccnaagggaattctttcaacgaagggcctttggttattttggcaaaagccacccttttggagggccaaaccgttgggaagggaagttggcttaacccggcttaacttttcaaacccaaagttggttcccttctatattttggcgccccatatgcgggagagtctccaagggccggagacactatacctctttatgcccagaaggcgaatctcgggacgcccctctcctttcctcgacaaaggagcagaggggaaacaccaagaggcttgttgcctggggcggcacctatgtggcgcacaagaggaacacttacaagggtgagtgggacctcagaagcgcacaacgttttaacaccgtccccgcgggcccagaacttgtcga

SEQ ID NO: 416669 - DNA, 1451 bp, Homo sapiens
cccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccgccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416670 - DNA, 1215 bp, Homo sapiens
gacgagtcctacatcaagacccaagtgaacaaagagctggagcagctccaggggctggtggaggagcggctcaaggccagcgaagaaaggctcagcagcaagttgactgcactaaagcggatgaagaccccggagccaacttgtttccggtgagggcgggacagtctggtctgctcgtgaatatttataaaccggctcccccgcaggcgccacctgtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtggaagtacctggacgtccattccatgcaccagctggagaagaccaccaatgctgagatgagggaggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattgcaacccccttgggcaacgtggaggagtgctaccgctacttcaccagtgtccttttttgccatggagtcaggcggcctcctttcagcatcgacctcttcaaagaggaacagctgctggccttggaagactacgtggtcaacacttacttccgccacttcaagctctataaatacgtcttcacaccccaggtgcggctggatctgtctttgacttacatggggctacagccacccaaactgtggccagagagtgagacgggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416671 - DNA, 1445 bp, Homo sapiens
cccggatgtgaggaaacttctttatcttctgcttctattggttacgcttggtcccgccactcgggtcctctggcttcttcccaaacacctcctctttctctcggtgattggccaagaggcagttcccatagtaactgacaccgcgctcccacttcccagcctggaggacagcaccggccctcgtattagcaacctggaagagagggcgcccaggtgggcactcgcaacttctcacgtatctgcgcgttctcttcgctcccactggcgtgagcctgcgctttccgccttccttccctcacaagcccccttggcaaccgtcgccgttgagacggagggagacgcccccacggattcgccccgccgcgcctctccgcgcgtagattggccggagcgaggcgaacgggcccggccttggtagccgccgaccgagcgctggctgtcctggaacctaggcggcgggagcccggggcgcctcgcggcacggaagagcggcgagatgctcaaccgcaagaccagccactttttgggaatgagggtgcagtcggagcttgaacatctctccgagctgcggcgggaagcggggaaggatcgcagctcagtgcatgggtcggccgcgcggacgcgtgcgagtgtgcggactcagtggacgacggcggcggcggcgaaagcggatgaagaccccggagccaacttgtttccggtgagggcgggacagtctggtctgctcgtgaatatttataaaccggctcccccgcaggcgccacctgtcattatgcttactaacgttcgggacgtctcccgggctgcttgggcgaggagaggcaggggtgtgtgaccccggtggttactgtgctcgcgtagagcacctagggcctgctgaagccctccctcgcccgcgcctctccttagtccttgagatgagatggcaagttacagcggcttctccggcctgctggagattcgctacgggccaggacaccgcagctgccttccccaattcgctttctttccgcagccgccgctgccccgaccccggatctgcatgtgggtgctggctgagctgctggagctagggtgtcctgagcagagcctgagggacgccatcaccctggacctcttctgccacgcgctcattttctgccgccagcagggcttctcactggagcagacgtcagcggcttgtgccctgctccaggatcttcacaaggcttgtattggccacatccacgtcctccgagcctacatcaagacccaagtgaacaaagagctggagcagctccaggggctggtggaggagcggctcaaggccagcgaggaaaggctcagcagcaagttgactgcactagagcggcccttccagctacctccgggtaaaggcaagagcaagaccaagtgacccccaacattttccccaataaaggtctgggccagaatggcaccatccc

SEQ ID NO: 416672 - DNA, 6202 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416673 - DNA, 1818 bp, Homo sapiens
gggattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtga

SEQ ID NO: 416674 - DNA, 714 bp, Homo sapiens
ccccctccccgggtactggcaaccactaatctactttctgtgtctatggatttgcctgttttggacattccatttaaaaaggagtcatacaatatgttgccttttatgactggcttctttcagccagcagaatgttttcaaagttcatccgtgatacagtatttgttaatactgtattccttagacaaataatattccataatattgttataccatagtttatttgtttactgatggacatttgagtggtttctgctttttagctttttgaacagttatctacaagtttttttgtagacatacattttcatttcttttggatttatacctaggagttggaattgttggattgtatgtaactgtgtgttttaacattctaagaaaatgccaaattgttttccagtgtggctgcactattttacattcccatcagcaacgtatgaaggttccaagttacttgtattgtaaaagaaaatttttagtcatcctagtgggcgtgacatgatatctcattgtggtttgatttgcagttccctggtgattaatgatgctgaccatcttttcatgaactcattggccatttgtgtatcttgtttgaagaaatctctaagtcttctgcccggttttgtgggttgtttttgttgtttttgagacagagtcttgctctgtcaccccactgcacttcagcctgggcttcagagtgagactgtttca

SEQ ID NO: 416675 - DNA, 6335 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcccgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416676 - DNA, 6317 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcccgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416677 - DNA, 6139 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcccgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaacttggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416678 - DNA, 6284 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcccgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacttgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416679 - DNA, 3262 bp, Homo sapiens
atttgctgtgtacctattattatttactataatagtctatattttatttccttttaagagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416680 - DNA, 4579 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcccgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtga

SEQ ID NO: 416681 - DNA, 2551 bp, Homo sapiens
taataatcgtgttctatttcttcaaggtaatcattgcatgttatggcaaataactttatcaaacccacaatttaatctcggtgtactttgatttgtagtgttcagtttagtaaatctagaggtaaacttttatttatacttcttaaaatctgttaaatattaactgttacttcctttccccttcaccctgctttcagtgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416682 - DNA, 5150 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcccgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgtttacgagttttagaaagtgtaactgtgcataatcccgaaaatcaaagctacttgatagcatataaagattcccaacttattgtttcatcagctaaagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatgagtggggcagcaccaaaacaggagagcaggacggtctcataggcacagcgctgaactgtgtgcttcaggttccaaagtacctacctcaggagcagagatttgatattcgagtgctgggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaagcccttcagcatgccggcaaacacatggaggattgcattgtggcctcctacacggcactacttcttgggtgtctctgccaggaaagtccaatcaatgtaaccactgtgcgggaatatctgccagaaggagacttttcaataatgacagagatgctcaaaaaatttttgagttttatgaatctcacttgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416683 - DNA, 2114 bp, Homo sapiens
agttggtatcctaaagtattacggactacgagcagtaagcatatagcttgtctcaaagattaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattgttcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccataaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaata

SEQ ID NO: 416684 - DNA, 3071 bp, Homo sapiens
cgcgcggggactgtgggaagcggagtgacggagcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcccgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgaggagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcagaaaacttggattttacagaggacttgcctggtgtgcctgaaagtgtgaagaagcccataaataaacaaggagataaatcaaaggaaaataccagaaagatttttagtggccccaaacggtcacccacaaaagctgtatataatgccagacattggaatcatccagattcagaagaactgcctgggccaccagtagtaaaacctcagagtgtcacagtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaattatatactgttgttcagcacgtgaagcacttcaacgatgttgtagaatttggtgaaaatcaagagttcactgatgacattgagtacttgttaagtggcttaaagagcactcagcctctaaacacacgttgccttagtgttattagcttggctactaaatgtgccatgcccagttttcgaatgcacctgagagcacatgggatggtagcaatggtctttaaaaccttggatgattcccagcaccatcagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacggtgggttccttcttccttccttctaagatgagaattactttcagaaagtctttggttagttgcagtagctgtgtgactgtgggcaaattattttaattctaaccttggtttacagtttggcaaatttcttatgtttagatctgagcataatttcattccttgcctgaacttcctaaactagtttatctgtatttaggctttttgcccaataaatagttgcacatttt

SEQ ID NO: 416685 - DNA, 310 bp, Homo sapiens
taagtagcgtaggaatatgtactcattgtggaggaaaattgacatggaagcatgtagggtaataaatcagcctttctttataccccttcctcatatttgtttatttaaaagtctgtgtggtgagtgtcaaaagtcatgagggaagaatccctaggtttttatttttatatgcactgtttaacacttgtatttgatgattatatgttttcttaaattttttttcacagagaatatgaaactggtgtcaaaatgacatccagatttgggaaaacatacagtaggaaaggtggaaatggcagttcaaaattcg

SEQ ID NO: 416686 - DNA, 762 bp, Homo sapiens
ttttgttgtttttgagacagagtcttgctctgtcacccaggctggagagcagtggcacgatcagggcttactgcagccttgacgtcccaggctcaagcgatcctcccacctcagccttgcaagtagctgggagctacaggcgtgcaccgccacacccattaaaggtttttgaattttaatggagaggaggtctcactatgttgcccaggctggtctcaaactcctgagctcaagtgatccttccaactcagccttccaaagtgctagaattataggtgtgaggcaccacgcctggccctttgcccagttttaattgggttgtttttgttgttgagttgtaagaatgttttttatatgttctggatacttgacccttatcaagttcatgatttgcaaatatattttctcattctgtggattaatcttttcagtttgttaattgtgtcctttgcaacacaaaaattttaactaaaagttttatggtttcagcttttcttttggatccctatttcattttgattaaatttttgttaatctgtggatatccagttgtcctagcatcattcgttgatttgtagcagttttaaagtaaagataactaacagaatggttggttttgtgaggtttgtgttaattaatatactgttacaattctttacttcaattctctcagcccttcagcatgccggcaaacacatggaggattgcattgtggcctcctacacggcactacttcttgggtgtctctgccaggaaagtcca

SEQ ID NO: 416687 - DNA, 270 bp, Homo sapiens
tcttgtgaactgtctaatcttcaatgaggcctatccagtaaaatattcattgctaagatggtattttttggtttcacttgttttttttcatagcttaaatttctctcattatgtttatgtttccgaaacttcaagtccctgcacatataattactatttttttatgtttttgagagtgacaggatctcactttgttgcccaggctcagactgatcacaaactcctggcctcaagtggttcctcttggcccagcctataatcacttttttc

SEQ ID NO: 416688 - DNA, 492 bp, Homo sapiens
tgtcacttgactctgtagtgccacttaggtgtcatttcactgttgcacagatctactggaacttcactctccaagtcctctcacaacttgcttggccttactgtacttctcttatttgtggtacctgactattagccaacctttccttggtcttccactgtcatgcatgattctataactttttcctggtgcttataatattattttactggtcacatcctttctatctctctctctctctctctcccctttgggctcttctttctctctctctttttttttttttgaggtggagtctccttctgtcgctcagactggagtgcagtggcaccatctcagctcactgcaacctccactttccaggttcaagcgattctcctgcctcagcctcccgagtagctgggattccaggcaagcaccaccacacccagctaatttttgtatttttagtagagacgggtttttgccatgttggccaggctggtcttgaac

SEQ ID NO: 416689 - DNA, 378 bp, Homo sapiens
gaagtggattaaatcagttgctaccatcttcagtacgtattactgatgtgcctttgccctagtgtcatggtccctggacagtgatacattttctgaaagaagtaagatatttaaatgaaaaatctttcacctgctgcccccctataaaaccccacccactggctgggaatgggggtggggttcagggggagtgcctggcaattaaagttgtaaaaactcttgaacaaatagtctgggtccaaatagtctgggtccagtggttcatgcctgtaatcccagcactttgggaggccgaggtgtaagaatggcttgaacccaggagtttaagatcagcctgggcaacatagtaagacctttatttgtctctacaaaaaattt

SEQ ID NO: 416690 - DNA, 1346 bp, Homo sapiens
gttcttattccccctcccccatttttatgtaggagaaaataccgtacaaacccttctgcacattggacttgagatggcttttccatctcagtgcaaaaaggcgacattttttcttaaccactgcacattatttggttatcacccagtttagggacattgagtttcttttgtactctagtgcttgaatgattatccttggatgtacatctttccttgtatatttaaatatgtctcatctcagtttccacaggtggaattgctctgcaaaaaggcatatatgtatttttaatttgccctctatgtaccaaatgttttcaccccagcattgctgatggattagagtgctgccaagtttttggatttttacctaccagcttttgaagggcagattatttcaagtcttaattaatattttcaggaacagtaacaatatcatttggttaaattgagagaaatggggttcagttgacagaatttgttcaggatatagaatttttctgctgctgctcctgcagctacacacctacaactagtaaaaacatggttgcttaggttgtcaaatgaccagcaaacctggagaggaacctggaatgactataaacagctccacccacactttttttgggcaaatgtgcaagcttagtagaatctaaaaggatacttcagcctttgtttgagttgcagaaaattaacatggtaaggaggaaaaaatcactaatttttttaaaaagttccctgatacaggaactgaaaatgatttttgaccaacctgggcaatagagcaaaatcccatctctacaaaaaaatacaaaaattagtcgggcatggtggtgctgcctgtagtgacggctactcatcctgaggtgggaagattgcttggggccaggaggttgaggctgcagtgagccaggatcacaccactgcaccagcctgggctacagagtaagactcaagaaaaaaaaaagatgtttaattaatcttgcttcagtgctgaggtggtacagggagggagaaagggatattgggctatgaattccatctaaactggggatttttatcagggtgtgaagaaagattttcaggaataattatctgagttacttggagtaaaagtagcaggaggaggaaaagagatatggcctgtgggtctctgacttgccaaacttcttattcattttacaaatcatgatttctagagcatcttaatctttgaggcccagctgcttggaagttgcataatctctatacttcagttcccccctataaaatggggaatatgatagaatctaccttgtatttgagaggactaaataaatataaagtgcttagaaaagtaaggactcaac

SEQ ID NO: 416691 - DNA, 1195 bp, Homo sapiens
gttcttattccccctcccccatttttatgtaggagaaaataccgtacaaacccttctgcacattggacttgagatggcttttccatctcagtgcaaaaaggcgacattttttcttaaccactgcacattatttggttatcacccagtttagggacattgagtttcttttgtactctagtgcttgaatgattatccttggatgtacatctttccttgtatatttaaatatgtctcatctcagtttccacaggtggaattgctctgcaaaaaggcatatatgtatttttaatttgccctctatgtaccaaatgttttcaccccagcattgctgatggattagagtgctgccaagtttttggatttttacctaccagcttttgaagggcagattatttcaagtcttaattaatattttcaggaacagtaacaatatcatttggttaaattgagagaaatggggttcagttgacagaatttgttcaggatatagaatttttctgctgctgctcctgcagctacacacctacaactagtaaaaacatggttgcttaggttgtcaaatgaccagcaaacctggagaggaacctggaatgactataaacagctccacccacactttttttgggcaaatgtgcaagcttagtagaatctaaaaggatacttcagcctttgtttgagttgcagaaaattaacatggtaaggaggaaaaaatcactaatttttttaaaaagttccctgatacaggaactgaaaatgatttttgaccaacctgggcaatagagcaaaatcccatctctacaaaaaaatacaaaaattagtcgggcatggtggtgctgcctgtagtgacggctactcatcctgaggtgggaagattgcttggggccaggaggttgaggctgcagtgagccaggatcacaccactgcaccagcctgggctacagagcgagagctccgtctcaaaaaaaaaaaaaaaaaaaaaaataaatttattatcattgactattatattatcatgatacaccacccaacgcctacctacccaaaaatccttcctatcttgcttaccaattaaattattaaattgaggaatcaatagtgatgcctaggtttggggcatgttgtctaggtggaattaattttaattacacttttaacccctagcatatccaaatattatttcacatgtgatcaacat

SEQ ID NO: 416692 - DNA, 594 bp, Homo sapiens
  misc_feature (36)..(36): n is a, c, g, or t
  misc_feature (98)..(99): n is a, c, g, or t
  misc_feature (131)..(131): n is a, c, g, or t
ggggtcaagaccagcccgggcaacatggcaaaaccncatctctaccagaaatacacagaattagccaggcatggtggctgcgcctgcagttccagccnntaaggaggctgaggtgggagaatccccgagcntgggaaatccaggctgcagtgagccaggatcacaccactgcaccagcctgggctacagagtaagactcaagaaaaaaaaaagatgtttaattaatcttgcttcagtgctgaggtggtacagggagggagaaagggatattgggctatgaattccatctaaactggggatttttatcagggtgtgaagaaagattttcaggaataattatctgagttacttggagtaaaagtagcaggaggaggaaaagagatatggcctgtgggtctctgacttgccaaacttcttattcattttacaaatcatgatttctagagcatcttaatctttgaggcccagctgcttggaagttgcataatctctatacttcagttcccccctataaaatggggaatatgatagaatctaccttgtatttgagaggactaaataaatataaagtgcttagaaaagtaaggactcaac

SEQ ID NO: 416693 - DNA, 682 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcagactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 416694 - DNA, 738 bp, Homo sapiens
  misc_feature (738)..(738): n is a, c, g, or t
aggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcagactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagaaaaaaatcgaccaagcttatgcatgcgggcgcatttgagctaacttgccaattccn

SEQ ID NO: 416695 - DNA, 620 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacaggcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 416696 - DNA, 1046 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcagactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcaccagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 416697 - DNA, 1183 bp, Homo sapiens
aggggaaaggggaagtttgggaggaaggcttctgagaagactggtgggagagaaggagagcctgcagacagaggcctccagcttggaggaaaagctttcagactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcaccagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 416698 - DNA, 1496 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcagactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcaagaaatacatggagtttgaccttaatggaaatggcgatattggtgagaaacgggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 416699 - DNA, 621 bp, Homo sapiens
aggggaaaggggaagtttgggaggaaggcttctgagaagactggtgggagagaaggagagcctgcagacagaggcctccagcttggaggaaaagctttcagactgctgaaggcccagcaggaagagaggctggatgagatcaacaagcaattcctagacgatcccaaatatagcagtgatgaggatctgccctccaaactggaaggcttcaaagagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 416700 - DNA, 476 bp, Homo sapiens
tggatggggagggcctaccctggctcttattttcccctccatagcaattcctagacgatcccaaatatagcagtgatgaggatctgccctccaaactggaaggcttcaaagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccaga

SEQ ID NO: 416701 - DNA, 1363 bp, Homo sapiens
aggggaaaggggaagtttgggaggaaggcttctgagaagactggtgggagagaaggagagcctgcagacagaggcctccagcttggtctgtctccccacctctaccagcatctgctgagctatgagccaaaccagggatttacagggaggaaaagctttcagactgctgaaggcccagcaggaagagaggctggatgagatcaacaagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacaccctagcggggcccctcaactccccaaccccacttcctctgcctgcccctcctcctccttccacgttgtctcctccacctagcagttggttggcaaccccttcctcagtcccctgctgaaaaccctccagtcagcgcttatcccttctgctctctcccctcaccagaaatacatggagtttgaccttaatggaaatggcgatattgatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaaggaaaagccaacaggccccccagccaagaaagctatctctgagttgccctgatttgaagggaaaagggatgatgggattgaaggggcttctaatgacccagatatggaaacagaagacaaaattgtaagccagagtcaacaaattaaataaattaccccctcctccagagaagaacaaaaaagaaaaaaaacaaaccgtggtggggcgcgctgtgggcccggagaaaagttcttcgagagaacccaccggtgggagcgcgccggggccccaatgggtctaggcgaaccgggggccaagacgggttcccaaagaggaaacccgggccaagagaactaaggggcgggggattcctcccaccaataataaaaaggccccgggggggaacaccgacgggttttctgaaacaatcccgaaagagaacccggagggcacaatagcgggcactttcacacgggggacccccgagggagccgattataaataca

SEQ ID NO: 416702 - DNA, 420 bp, Homo sapiens
  misc_feature (1)..(1): n is a, c, g, or t
  misc_feature (9)..(9): n is a, c, g, or t
nacattctnaggaaactcgaaggaaggaaggcattgtaaagctgaaacctcatgaggaacctcttcgttctgagatcctcagtggaaaattcaccatcttagtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416703 - DNA, 1133 bp, Homo sapiens
gtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctgggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattc

SEQ ID NO: 416704 - DNA, 494 bp, Homo sapiens
  misc_feature (1)..(1): n is a, c, g, or t
  misc_feature (9)..(9): n is a, c, g, or t
nacattctnaggaaactcgaaggaaggaaggcattgtaaagctgaaacctcatgaggaacctcttcgttctgagatcctcagtggaaaattcaccatcttagtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaaaaacaaccattcttaggcttgtggccacgaacctgtgggtatacaaaacaaaaggccttcctggccccagg

SEQ ID NO: 416705 - DNA, 398 bp, Homo sapiens
aaatgaaatggaagacatttttgcacacacagtgaggaaatagtggaagacgctggcaatccacagccatgtggagctgtgagtcaattacatctcctttctttgtaaattaccaagtcttgggtagtttatttaagcagtgtgagaatgtactaatacagtgttcttcaatccttgaggatcccaaatggaagcccagggaatggtagctggggacaaccccagatgttcaccggggacagggacattaagtaactggtccatgattcacacaggtaattagtgacagagcctgaatttgaacccagatagtcttactcaagagccctttctctgacctgtggtccttctagattctccgactcttaaagtcttgtaataaatatcttacacgtata

SEQ ID NO: 416706 - DNA, 2638 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416707 - DNA, 2623 bp, Homo sapiens
  misc_feature (15)..(15): n is a, c, g, or t
  misc_feature (17)..(17): n is a, c, g, or t
ttgttcagaggatcncnttcgacggtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416708 - DNA, 2877 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttatgctgacagcataaactattacctacttgggacatgagctatctcagggcattcagaagctcacccccaaatgtcttaagtcaattttgtttatctctctccccaaaacaaaaaaaaaaaacaactttatacggctgggcgcagtgtttcacgcctgtatttccagcactctggaaggccaaggtgggaccacaggcgtgagccacggcgcccactgtggctcaccttttatgtaacaaagtcaaagttgtgagttttttttcagttgctgtggatcctcagaatagtttatgcggggattcctcta

SEQ ID NO: 416709 - DNA, 1452 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattc

SEQ ID NO: 416710 - DNA, 1411 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416711 - DNA, 1738 bp, Homo sapiens
  misc_feature (1453)..(1453): n is a, c, g, or t
  misc_feature (1475)..(1475): n is a, c, g, or t
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattcnaaaaaaaaaaaaaaaaaaaaanaaaaaaaaaaaaaaaaaaaaaaaaaaaaaaaaaaaaaaaaaaaaaaaaaaaaaaaaaaaaaaaagaaaaagagaaaagaatagcaaaacaacagaaaagaaaaacagaggccgcagcgatatcacaagaggaaagggaaaagaaaaaaaggcagaaccaagaggggagggggaaggaagatcagaatcagcagcagagcgacgacgggaggagacaagcagacaaaggacgaaggaaaaaagacagacgaaacaaaacaaaca

SEQ ID NO: 416712 - DNA, 1404 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaccggacatttatttatgatatacacgaaatatggacgaggttgacttttgaaaaacctcttaggtgaaagtggaggtgcgcaaaggatgggcacactgggcaggcgcctggacttgaccacgatggacgggaaaacggaaatgaacccacctgcacaggggaagccactggaggcaaagaggggaaaaccgcagcacaaggtcatctcacgt

SEQ ID NO: 416713 - DNA, 1398 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtaaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattc

SEQ ID NO: 416714 - DNA, 1697 bp, Homo sapiens
  misc_feature (1412)..(1412): n is a, c, g, or t
  misc_feature (1434)..(1434): n is a, c, g, or t
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaanaaaaaaaaaaaaaaaaaaaaanaaaaaaaaaaaaaaaaaaaaaaaaaaaaaaaaaaaaaaaaaaaaaaaaaaaaaaaaaaaaaaaagaaaaagagaaaagaatagcaaaacaacagaaaagaaaaacagaggccgcagcgatatcacaagaggaaagggaaaagaaaaaaaggcagaaccaagaggggagggggaaggaagatcagaatcagcagcagagcgacgacgggaggagacaagcagacaaaggacgaaggaaaaaagacagacgaaacaaaacaaaca

SEQ ID NO: 416715 - DNA, 1220 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaaattggctccatttaaagcgattaaagtggagatctgattggataacttcatccaaattctgtaaacgccacttccgcacaaacggttgcttgcaatcaatttaatttttcaaataaaatgattaaatt

SEQ ID NO: 416716 - DNA, 2580 bp, Homo sapiens
aggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416717 - DNA, 2569 bp, Homo sapiens
cacgcgtcgcccacgcgtccggtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416718 - DNA, 2590 bp, Homo sapiens
  misc_feature (15)..(15): n is a, c, g, or t
  misc_feature (17)..(17): n is a, c, g, or t
ttgttcagaggatcncnttcgacggtgttctgagggaagcaaggaggcggcggcggccgcagcgagtggcgagtagtggaaacgttgcttctgaggggagcccaagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416719 - DNA, 2592 bp, Homo sapiens
actggagcttcctctccgcctccttcgcctagcctgcgagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416720 - DNA, 2480 bp, Homo sapiens
gctgtggctgacttagaggatccgatgttatgccaacaacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416721 - DNA, 2429 bp, Homo sapiens
ggcctatcctgagagtgtactgatggaatcaaaggatgcggtggtggacgaatgaagtggtgagtactgaaaatgttgattatgaggtcaggccaagggatccaatgaccatgtcactggtagtggtaggactagatctatcatgatgaaattgcctgatttgtacactgtctcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416722 - DNA, 2319 bp, Homo sapiens
gtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctgggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416723 - DNA, 1794 bp, Homo sapiens
  misc_feature (7)..(7): n is a, c, g, or t
  misc_feature (69)..(69): n is a, c, g, or t
  misc_feature (71)..(71): n is a, c, g, or t
  misc_feature (81)..(81): n is a, c, g, or t
  misc_feature (105)..(105): n is a, c, g, or t
  misc_feature (114)..(114): n is a, c, g, or t
  misc_feature (119)..(120): n is a, c, g, or t
  misc_feature (133)..(133): n is a, c, g, or t
  misc_feature (138)..(138): n is a, c, g, or t
  misc_feature (191)..(191): n is a, c, g, or t
  misc_feature (193)..(193): n is a, c, g, or t
  misc_feature (205)..(205): n is a, c, g, or t
  misc_feature (208)..(208): n is a, c, g, or t
  misc_feature (210)..(210): n is a, c, g, or t
  misc_feature (217)..(217): n is a, c, g, or t
  misc_feature (226)..(226): n is a, c, g, or t
  misc_feature (231)..(231): n is a, c, g, or t
  misc_feature (317)..(317): n is a, c, g, or t
  misc_feature (342)..(342): n is a, c, g, or t
  misc_feature (344)..(344): n is a, c, g, or t
gcttatnggcgctttttgttgttcttatgatattaccctcttattttcaaggcttatcagcccccgagncnttggggaacngggcggttacggggcgacagctgngcaacgttnggtannatcattcttttanaaganataacatcagtagatgctaactttcttaccattattcgcgctacgatggttcnanatttcggtagcnggngncctttcnctcatgctnccgcnccaggagccttgcgagcttacgtttcgcctactttgcttcagatcactatagagctatttcttccccccacccgccaggtccgggnggccttttatcttacatcgtctacncncgaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaa

SEQ ID NO: 416724 - DNA, 429 bp, Homo sapiens
  misc_feature (15)..(15): n is a, c, g, or t
  misc_feature (17)..(17): n is a, c, g, or t
ttgttcagaggatcncnttcgacggtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaatcttgttgggacccatgagcccctatcagatgtgtgggcgataggtaccggctca

SEQ ID NO: 416725 - DNA, 459 bp, Homo sapiens
cacgcgtcgcccacgcgtccggtggaaacgttgcttctgaggggagcccaagatgaccggttctaacgagttcaagctgaaccagccacccgaggatggcatctcctccgtgaagttcagccccaacccatgtggagctgtgagtcaattacatctcctttctttgtaaattaccaagtcttgggtagtttatttaagcagtgtgagaatgtactaatacagtgttcttcaatccttgaggatcccaaatggaagcccagggaatggtagctggggacaaccccagatgttcaccggggacagggacattaagtaactggtccatgattcacacaggtaattagtgacagagcctgaatttgaacccagatagtcttactcaagagccctttctctgacctgtggtccttctagattctccgactcttaaagtcttgtaataaatatcttacacgtata

SEQ ID NO: 416726 - DNA, 802 bp, Homo sapiens
ggcctgttgatgccactgctgttgaagtctatgtgaatggtgccccctggtggaaggaaaaagagaatgggacgccaggaatgtcagatgcttttcagcctctcccctgctctcacgcctagaaacaagagctccacaaaggtctctcattcctcaaggctgatgaaaagcccagcagctaaatggccagaagcctgtctttgtgagaaagcaagaagtctctcggtttgaactcttcggtctagagacagattcttctaccagtggtgtaaaaccctaaagaggctctgcataagacctaccactgctctgtgtctcatgacaccctgcccccaccactggaaggccacacttattctttgtgttcatgcttctctatgatctgcaagtttcccaagaacacctggattcgaagctcaagtccaccgctaaatagctatgtgacctaatgtgtcagatggttataaggattacagagaaagaggtatagatagagctggtagcagtgacagacacatctttacatcatataattctgacatgcattattattgtagttttctgttattcagacatacttgttaagaaggtgctggggacaatttgtacatgctgggtatgaaagggcttggaaagtatttcatgaatggagttggcattgaggagtccaatccatgtacaatgggtagaattagaaaggcattgaggatagtgtattagtctgttttcaaactgctgataaaaacatacctgagagtgggtaatttataaagaaagaagaggtttaatggactcacagttc

SEQ ID NO: 416727 - DNA, 737 bp, Homo sapiens
atcattagagatttaagggttatatgtacaccataaggactgttctcattggcttttcttcagtaacattattaatttacatcatttgcttggtttgctgtcactattgtgttcttatctccccaacaaataaaaagcattcaaaaaggtttattgaaacataaaattaataatgaaagtgagaacagatgtctgtaactcatcaacttggacagtatactggattgcagagtaaattctgtatgttcacccatatgtccttgaagaagtaaatatttgggatgactttgaaattattcgaaaagggaaagtacaaacagatgctctgattattattgaaatgatccttcattgatctgtccctagttttctgtgcatttgacatgaaacatggtcaaagtatgttcccactgaaattttgcattgtttttcaacaaagcatggtagtaaattaaggaaattattctagaataagtcattaaatgcagagaagagatcaaaagagtagaggcatcttttacagttgcactgcttacagcaatgataggtaacaagtcatactgttcctaagaagtttctaaaggcatccacagagaatgggaaaaatgctctgaacgatcgttgaatgatctattggcaaaatttctttgtcatgtgccaccgttaagcattccatatttgctagtgggtataatgggcatacattgtgacaggaacaattacttgcatatgtggct

SEQ ID NO: 416728 - DNA, 2652 bp, Homo sapiens
  misc_feature (1053)..(1053): n is a, c, g, or t
  misc_feature (1148)..(1148): n is a, c, g, or t
  misc_feature (1308)..(1308): n is a, c, g, or t
  misc_feature (1313)..(1313): n is a, c, g, or t
  misc_feature (1838)..(1838): n is a, c, g, or t
  misc_feature (2328)..(2328): n is a, c, g, or t
gctgccttagagcttctagggtaacaaagacgtccctcaggaggatcctgagacttacttccagaacagagcttcagggcgaccacagggcacggcacctgtactactgccacttgaaggagcgcgtgctgaggtcacagtgcgctcaccgggaggaagcctacttcctgctggctgcctgcgcgctgcaggctgacctgggcgagcaccgggagtcggcccatgccgggaggtacttcgagccacactcctacttcccacagtggatcatcaccaagagggggattgactacatcctccggcacatgcctaccctgcaccgtgagcgccagggcctgagccccaaggaggccatgctgtgcttcatccaggaggcctgccggctggaggacgtgcccgtgcacttcttcaggctgcacaaggataagaaggaaggtcgtcccaccgtgatcctgggactggccctcaggggagtgcacatctaccaggaggtggaccgtgctccgcagctgctgtacgacctcccctggccccacgttgggaagctggcatttctgggaaagaagctggagatccagctggatgggctgcccgcagcacagaagctggtttactacacggggtgcacctggcggtccaggcacctgctgcacctgctgcgcgccagccaccagctccacctccgcgtgcggcccactctgcaacagctgcggcagcgggaggaggcagaagagaagcagcactaccgggagtcctatatcagcgatgagctggagctggacctggccagcaggagcttcccgggcagtggggtcagcagccagcactgcccccactgcctctcacgccactccgccgacagccacggcagttcctacacgtcaggcatcaaggccaactcctggctcagggaatccagagagatgtctgtggacgtgcccttggaggtccacgggctccatgagaaggagccgtcctccagccccaggaccagccgcagccaccccagcacacgtggtgacagccaagccactcgtcaggagccctgcaccnaggtcaggaccagaggccagagcgccgaggccgtgcaccagatccaggaaatgacagccggggtcagtgaggagcagcacagccatggcctggangacatgcagctgcaccagctggccctgcacccagcgcccacctcactcagccataccttccaccgcgccctggactgcaggctggcaggcccctgcgagaccagggccactctccccagcaagaggtccagcaactgtctcgccctggacctgttcgganaggcnccaccacaggagtttgtggtgtaggcaccacccacccagcagtaccgtccgcaccgccaggctcagcccctgcccaccccacttccacatggccctcgtcccttcctgcccgccagatgctgcctgcacttccgcagccagcacgctccacaggttcacctgtaagaggtgtggagctggctctgacatcaacctgggaggtaacaaacaggtcccgcacctcatgcctgtctgccatacacccgggagctctttccctcagggtctcagggagccagttcaaggtctggctgtcaagtgtccagagagccatggtgttggcccctgaggcagcctgtcacccatcctaatctgggagagaaggtgacacagctgggcccagaccctggagagacagctctgcagtttcccacactgtcagctccccaagagacagtcctgatgggcacaggctgccagagctcccaagccggagttcacagttatcatcactgtgcaggacccaggttcctcccagacctgaanccctctctgcaactcctgtttgcaagcgctgggcctgccagacagaggcccctcttgtggtgcaagcccagctctgtcacctgagatccagccagagaccctcctccaccatccacagtcaatggctgtgctttcccttccaagccagggcttccaaagaccccactgccccggagctgaagccgactctgctcccatctcagccatgaggcctcaggacccactctgctcacaggtggcttccttaagccattgccctggctggggttgggctggtgcagcccagctggcggaggggcgaagctttggtgacagacggagagtgggggactagctgtgcatggcacctgctctgatccggtgggctccacgggtagtgcgacctcggttctgtgggctctggaaggccaccagggtagggtctccccagggctcctccccctgcacaacactcctgcacacgtgcaaacctgctgtcctctgcatttanaggaatggcccgtgcatccctgctagtctcaggcccatcccagagcactgagaggccacaatcgttcagccctgtgccctgaacaccactgcccccttcactgtctgtgtgtggtgaagaccacgccacaccaccctccagctcactggagacaagcatgagcttgagccccatggcctggtgcagggctgcgtgcattgaggccgcctctttgacgggtccatccagggggaccctctcctttctgtgaaagggaatcgtgtgtgtgccccaggcacgtgtaataaagaacccgagcagatgcctcctgcttgaaccaggacc

SEQ ID NO: 416729 - DNA, 1640 bp, Homo sapiens
cgcgacccctccccgctgacctcactcgagccgccgcctggcgcagatataagcggcggcccatctgaagagggctcggcaggcgcccggggtcctcagcgctgcagactcctgacctgccgactgcggatcccgagtccccggatcccggacccatcctgtggagcccactcctggcagacgccgcgatgcccggcccttggttgctgctcgctctggctttgaccctgaacctgaccggtgtccccggcggccgtgctcagccagaggcggcccagcaggaggcagtgacggccgcggagcatccgggcctggatgacttcctgcgccaggtggagcgcctcctcttcctccgggaaaacatccagcggctgcaaggggaccagggtgagcactccgcgtcccagatctttcaatctgactggctctccaaacgtcagcatccaggcaaaagagaggaggaggaggaagagggagttgaagaagaggaagaggaagaagggggggctgtgggaccccacaaacggcagcaccctggccgacgagaagatgaggcttcatggtcagtcgatgtaacccagcacaagcggcagcatcctggccggcgctccccctggcttgcatatgctgtcccgaagcggcagcacccaggcagaaggctggcagatcccaaggctcaaaggagctgggaagaagaggaggaggaggaagagagagaggaagacctgatgcctgaaaaacgccagcatccgggcaagagggccctgggaggcccctgtgggccccagggagcctatggtcaagcgggcctcctgctggggctcctggatgacctgagtaggagccagggagctgaggaaaagcggcagcaccctggtcggcgggcagcctgggtcagggagcccctggaggagtgaacccagttttccctgaagtcgagtttgtggtctaaggatgtcttgagccctgtgtgccccaccattcatgacctctgtattctctagttagatccctgaccataagcctgagcccctccctcccagccccatattcacacacatcccagcccctggccttgccctcttcctttaggcatgtgagaaaatcagcctagcagtttaaaccccactttcctccacttagcaccataggcaagggggcagatcccagagcccctctcaccccccccaccacaggcctgctccttccttagccttggctaagatggtccttctgtgtcttgcaaagactccccaagtgggacagggagcccctgggagggcagccagtgagggtggggtgggactgaagcgttgtgtgcaaatccagcttccatcccctccccaacctggcaggattctccatgtgtaaacttcacccccaggacccaggatcttctcctttctgggcatccctttgtgggtgggcagagccctgacccacagctgtgttactgcttggagaagcatatgtaggggcataccctgtggtgttgtgctgtgtctggctgtgggataaatgtgtgtgggaatattgaaacatcgcctaggaattgtggtttgtatataaccctctaagcccctatcccttgtcgatgacagtcatcctaatgataataaaacctgcatccagataatcac

SEQ ID NO: 416730 - DNA, 522 bp, Homo sapiens
cgcgacccctccccgctgacctcactcgagccgccgcctggcgcagatataagcggcggcccatctgaagagggctcggcaggcgcccggggtcctcagcgctgcagactcctgacctgccgactgcggatcccgagtccccggatcccggacccatcctgtggagcccactcctggcagacgccgcgatgcccggcccttggttgctgctcgctctggctttgaccctgaacctgaccggtgtccccggcggccgtgctcagccagaggcggcccagcaggaggcagtgacggccgcggagcatccgggcctggatgacttcctgcgccaggtggagcgcctcctcttcctccgggaaaacatccagcggctgcaaggggaccagggtgagcactccgcgtcccagatctttcaatctgactggctctccaaacgtcagcatccaggcaaaagagaggaggaggaggaagagggagttttttccctcaaatgttcctgatcctttctagcaccccggcctt

SEQ ID NO: 416731 - DNA, 392 bp, Homo sapiens
  misc_feature (22)..(22): n is a, c, g, or t
ctgcagagtaaagggtgctganttagaggtgatgctgtagaggtaaacagaggcaacccggtcaagacatctgggcttcctgaaaacagcaaggaaccactgaaggatcttaagcaggatttgtcatgtatctttttcaccaaactgcaaattccaggagcccagtagcagtgtctcttttttcttcttcacattatttatccagggcctaacccagtgcatgatacatagaaaatgctcggtaaacatctgaagaataaatgggatgatcagatatgcagaaacatcacttgtcaataatgtgaaaaacgtgtgaggaaataaatgctggaaaaaattaaaacagtaggccacggagaaaggcacagattaaagagattctgttttaaggg

SEQ ID NO: 416732 - DNA, 696 bp, Homo sapiens
agtgtttctctatcctgaagtcatgaagatattcttattgtcctccaggagttttaagatttttgccttttccatggacagtgctggtctaatgagttccactccacatagtatgcacagataggccagaatgctaatatactaacatttgaagagtgagaaagtcagttataaaaatccaaactccatccactgttgcccagatgtagtagaagctgaacagtttgagcttagaagtagaagaatctgacccagagagtaccctaaattcttggagaggagacagaagcagcagatttaaagggcttattgtggaggactcatggtaggacagaacttggtttttgcaaaatctctagacattgagttatgtgtaagtcttcagaggcaaattcatttagcgttttaccttttgcagtcctgaaggaagagatgtcacagataaccgcttggtggttctcctggcccgaaggagtgtgtttccctgggttatctcctctgtctctgcctctacaacatcaagttgtatagtcgcttccaagaaagggggaaaaaggaatctgtaaggatcacaatgaggaacacattcttcctgttaaaaatacagtattcttagaagacagcatcacttgctgcttcagtggctttttttttctttagagttaagaataaaaaattgatttgctcttcccaatc

SEQ ID NO: 416733 - DNA, 479 bp, Homo sapiens
attgggagagttgaccacccaagatcatactttatggatatgaacattcatctttcaattaggattcattcagtttcatcatttcgagcactcttatgcctcaaacccctacacatctctgttaaaataaaatcccattagtcatctaactgtcctaatatcccctcatagtcattaaattgttttgaagtgttcttaacaccttctcctttgcatgtgtctgttttcaaaattgaaacatcagtgtttggaagtttttcagtggttattaaagtgttgactctggaggactgtttacagctggaaatctaaagatttttctcatcaatgtacacaataaggaccccattcttatctacaggatatacattaaaagcagaattgagaatgtcacatgctgggttgagaatgacacaccaacaaactctctaatggaggagactgtacccatgaaaaatgcaataaactatcttgtgtga

SEQ ID NO: 416734 - DNA, 1127 bp, Homo sapiens
aggaaggtccgtggctgtagataagaagggggtccttatggtgtacatggatgagaaaaatctttagatttccagcggtaaacagtcctccagagtcaacactttaataaccacggaaaaactgtaatctccccgccactcaggaggctgaggcaggtgaatcactggaatccaggaagtagaagtgggatggagccaaatacgcaccactgcactccagcctgggcgacagagtgagactctgtctcaaaacaaacaaacacacaaacaaaacccatgcatacctatggataagtaaaagcattggtttggagagtcctagataatctacgctgcactgtctgtgttgtacatatggctatttacattttagtttcaatgaaaattaagattaaaaattcagttcctcagttgcactgaccagatttcaaagtctcaaagccaaatgtggctaacggctactatattggacaatgcatacttacatcttcacagaaagttccactggacagtgctggtctaatgagttccactccacatagtatgcacagataggccagaatgctaatatactaacatttgaagagtgagaaagtcagttataaaaatccaaactccatccactgttgcccagatgtagtagaagctgaacagtttgagcttagaagtagaagaatctgacccagagagtaccctaaattcttggagaggagacagaagcagcagatttaaagggcttattgtggaggactcatggtaggacagaacttggtttttgcaaaatctctagacattgagttatgtgtaagtcttcagaggcaaattcatttagcgttttaccttttgcagtcctgaaggaagagatgtcacagataaccgcttggtggttctcctggcccgaaggagtgtgtttccctgggttatctcctctgtctctgcctctacaacatcaagttgtatagtcgcttccaagaaagggggaaaaaggaatctgtaaggatcacaatgaggaacacattcttcctgttaaaaatacagtattcttagaagacagcatcacttgctgcttcagtggctttttttttctttagagttaagaataaaaaattgatttgctcttcccaatc

SEQ ID NO: 416735 - DNA, 862 bp, Homo sapiens
  misc_feature (844)..(844): n is a, c, g, or t
  misc_feature (847)..(847): n is a, c, g, or t
aggaaggtccgtggctgtagataagaagggggtccttatggtgtacatggatgagaaaaatctttagatttccagcggtaaacagtcctccagagtcaacactttaataaccacggaaaaactgtaatctccccgccactcaggaggctgaggcaggtgaatcactggaatccaggaagtagaagtgggatggagccaaatacgcaccactgcactccagcctgggcgacagagtgagactctgtctcaaaacaaacaaacacacaaacaaaacccatgcatacctatggataagtaaaagcattggtttggagagtcctagataatctacgctgcactgtctgtgttgtacatatggctatttacattttagtttcaatgaaaattaagattaaaaattcagttcctcagttgcactgaccagatttcaaagtctcaaagccaaatgtggctaacggctactatattggacaatgcatacttacatcttcacagaaagttccactggacagtgctggtctaatgagttccactccacatagtatgcacagataggccagaatgctaatatactaacatttgaagagtgagaaagtcagttataaaaatccaaactccatccactgttgccccaggctggagtgcagtggtgcgtatttggctcaatccaacttctacttcctggattcaagggattcacctgcctcagcctcctgagtagctgggagattacagtttttcagtggttattaaagtgttgactctggaggactgtttacagctggaaatctaaagatttttctcatcaatgtacacaataaggaccccattcttatctacagcnacngtgaggatgctcgtg

SEQ ID NO: 416736 - DNA, 611 bp, Homo sapiens
cctcagtcaatgacaccatcacccacacagctgtctaagttagagcctgagagtcattttagatttcgctttccctcactattcgcatctaatttattaactaatctgatcaattctaactcatatacatctccctagtctttctccttttctccacgtcaacaatcactgccctaagactgttatcatctctctagtggcagtttgtaccgtgtccgtttggtatagctaaaactactttcccagaattatttcctcgtcgaaattcaggttagagttggacaaaagaatttgagtgatatttgggaggtagaagagaagccacagccattaccctctgacagctgttgttgcaacatacagacagttaccagtggattccagctcattctgctctccctcgctctgtgctcagctcttcccagtggccagccctgtccattagcagtagccccagtagccaccaccagatacttgtctgaggacctacagaaatggtagctaaatttctttggagtttttctctagactctttgtagccccacttcagcagctgaatgtgcttggattctcagggctccctgcaatctcaatttgtccaccttgccatg

SEQ ID NO: 416737 - DNA, 539 bp, Homo sapiens
tactcctctcttcaagaggcggcttaaatgtctttcctcttgtgtgtgagctgaacttagtgattcacttctaatgaataaggcagtgacagtgggggacttcatggactaggtcataagaagacactgggacttccattttggccacactctctcagatcactcactttggaggaggccagatgccacactgtgaacaggcccatggagaaacccatagtgaggaactgagggctcctacagcagctaagtaagtgggcttggaggtggattctccactttcagtcaagtcccagctgacataccacttgcaacttcatgagagaccctgagtcagaaccatccagctaaactgcttgcaaaattcctacagaaactatgacataataaatgtgcgttgttgtaagtaaatcaatttggggtaattttttgtgcagcaataattaactaatatgagtgtctaaagcagtcttttaaaacacaaacagattatttcccttctccgcttaatacatctcagtgacctctcatttcatctg

SEQ ID NO: 416738 - DNA, 673 bp, Homo sapiens
aatagctaccatttatttcatgcttatcataattgagatactgaactgggtatattatgtacctatgtcaattaaattttcataccttacattcttcaccacaattattaaggtgaaatttattaacccagcttaatgataaggaagctaaatatcaagatacccaattataatataaaagacacaaaatattatttaggaagaaaatttttcagcaacccagaatatgtttcttgttgtattaaggcacattttagttctctagcatttgagggttaggcaggggaagctcttactgtgtttataaatctcattgcccattaatgaacctgaagacataatcatacctggcaacaaattctagaaggaatatatactatgaatgtttatctaatgtatgttagagactataattatggtgtggcaaaaatataaagttatttttaaaactctttctctgttgactcactacaaaagccaagggcacaatatgatgtcataatgcagggaagtaatttcttcaggaaatgcaggtagtagagtctgagcatattgatttttggagctctagctcagtgtttcccaacctttgttcttcataaaactaaccctgctagatgtgaatagttactccatcagaaatgggttcgagttaaattgtcttggaaatgca

SEQ ID NO: 416739 - DNA, 447 bp, Homo sapiens
  misc_feature (329)..(329): n is a, c, g, or t
  misc_feature (369)..(369): n is a, c, g, or t
  misc_feature (440)..(440): n is a, c, g, or t
agctaacttagaaactccacaagtaaactttcccagtctggaatggtttagccatagtctagttgatgagaacaaataaaagggtaacattttaaactcaaaatgtttttgagttctttacagataactagaagatgaaattaagatcctataaagtggccacgcactgtggctcacacctgtaatcccagcacttttggaggcccaaagtgggagaatcgcttgagccccaagagtttgacaccagccccaggcagcatggcaagactccatttctacaaaaaataataaagaaatttagctgggtgtgatggtttgtaactgtagtnccaagctacttaggaggcagaggtaggaggactgattcancctgggaagttgcggctccagtaagcagagatcatgccaccacactccaacctaggtgacagaggcgattnctatctc

SEQ ID NO: 416740 - DNA, 535 bp, Homo sapiens
gctgctcatggccctctccctgcccaggaatgctcttcctggtggatgccccatcagctcttagggtgagggcagagcgaggagcaggtccacagctacctctcccagttcagccccatcctgggtccagtataatgtgtcccatgtgataagagacttgcagtcatagtcatcgggatcctgtgaccagggatctcacctaggagtctgttctccatcactgaatgccaatctgcgggggatcctggcaaatgactttgcagtgttttgctaaagagcaaaacaagcaaatatgctcagtatttgaagatggaagagttaaaacttcagcttgttttgaccagagtctgtacttaagtgagcctgacacgtggtagcttttaggatcaaccattccaactaggatgtttaggaaagaatactgttcaaaatcgctaatgagtgttttgggcatgtctgaaagatgatagaaattattcatctttgatgtgtaatgaaatctagaatatgatacattaaaaacagtaaactgaag

SEQ ID NO: 416741 - DNA, 552 bp, Homo sapiens
agaccagagaagtccctgctgcactccagggtctgagaagagacttcgacttggtggcatcacaggggaagaaggaagaagggactacaggagaaccaagggcatatgggcatgacctgaagattcctggtgttcaggtgaagatgtaaggaagtccacgaagtagatacagacttgcagtcatagtcatcgggatcctgtgaccagggatctcacctaggagtctgttctccatcactgaatgccaatctgcgggggatcctggcaaatgactttgcagtgttttgctaaagagcaaaacaagcaaatatgctcagtatttgaagatggaagagttaaaacttcagcttgttttgaccagagtctgtacttaagtgagcctgacacgtggtagcttttaggatcaaccattccaactaggatgtttaggaaagaatactgttcaaaatcgctaatgagtgttttgggcatgtctgaaagatgatagaaattattcatctttgatgtgtaatgaaatctagaatatgatacattaaaaacagtaaactgaag

SEQ ID NO: 416742 - DNA, 418 bp, Homo sapiens
aaggtgaaagagggtaaaaactcaatggtttaaatgtctttaggaccataatattgtaaggagggaatttaatggaatcaagaagagaggagaggaaatgtggtcccaaggcagaatgttttctttccaggtttcgtgatggtgcctattctaatgatgatgaagagtgatcaggtcatcaggagaaaggatatgggagatattgtgatgggaaagatcctctgatacaagaaggttaagaacctaggggtcttgtgattgcatggatcacctactggctgaagtttgtgtggtaaggaagagtgggtccaaagcagaactcatttgtgaatcaagaggaatgaccaagaactgagtacaaactactccaaaggggtagtttggaggtcagaatagcaagttttacaagaggaggatt

SEQ ID NO: 416743 - DNA, 2278 bp, Homo sapiens
  misc_feature (1625)..(1625): n is a, c, g, or t
atcccggccggcatggaggcggatttgagccagctgagcgaagaggagaggagacagatcgccgctgtcatgtcaagggcgcaggggctgcccaagggaagcgtccccccggccgctgcggagtcgccttccatgcacaggaaacaagagttggatagtagtcatcctccaaagcaatcaggaagacccccggaccctgggcgtccagctcaacctggtctcagtaaaagtagaactacagacactttcaggtcagagcagaaattgcctgggaggagtccttccactattagcttgaaagaatcaaagtccagaactgatttaaaggaagagcacaagtctagtatgatgcctggcttcctctcagaggttaacgctttaagtgctgtttcctctgttgtaaataaattcaacccttttgatttgatatcagactctgaggcatcccaggaagaaaccaccaagaaacaaaaagtggttcagaaggagcaaggaaaacctgaaggaatcataaaacctcctttacaacaacagccacccaagccgattcctaagcagcaaggacctggtagggatccgcttcagcaggatggcactcccaaatcaatatcttctcaacaaccagaaaaaattaaatcacaacctccaggtacaggaaagccaattcagggtcctacccagactcctcagacagaccatgcaaaattgccacttcaacgagatgcatccaggcctcagactaaacaggcagacatagtaaggggagaatcagttaaaccctcactgccaagcccatccaaaccacctattcagcaaccaactcctggaaaacctccagcacagcagcctggacatgaaaaatcacagcctgggcctgcaaagcccccagctcagccctcagggctaacaaagccattggctcaacaaccagggacagtgaaacccccagtccagccaccagggacaacaaagcctccagctcagcctcttggtcctgctaagcctccagctcagcagactgggtcagagaagccttcatcggagcagcctgggccaaaggctttagctcagcctcctggagttggaaagactccagctcaacagccagggccagcaaagcctccaacccagcaggtggggacaccaaaacccctagctcaacaacctgggctacagtctccagctaaggcacctgggcctacaaagactccagctcagacaaagcccccatctcaacagcctggctcaacaaaacccccacctcaacagcctggcccagcaaagccctcacctcaacagcctggctcaacaaaacccccatctcaacagcctggctcagcaaaaccctcagctcaacagcctagcccagcaaagccctcggctcagcaatttacaaaaccagtaagccaaacaggatttggaaaacctctgcagccaccaacagtgtctccatctgcaaaacagcctccttcacaaggcctccctaaaaccatctgtcctctttgcaataccactgaacttctgttgcatgttccagaaaaggccaattttaacacatgcactgagtgtcaaaccactgtctgtagtctctgtggttttaatcccaatcctcatttaacggaggnaaaagagtggctctgtttgaactgtcaaatgaaaagagctctaggcggggatctggctccagttccgtcatcaccccagcccaaactgaagactgcacctgttaccactacatcagcagtgagcaaatcatccccacagccacagcagacttccccaaagaaggatgctgcaccaaaacaggatctctccaaggcacctgagcctaaaaagccaccaccactagtgaaacaaccaacccttcatggctctccttcagccaaggccaagcagccccctgaggcagattctttgtccaagccagcccctcccaaagaaccttctgtcccatctgagcaggacaaggcccctgttgctgatgataaaccaaagcagcccaagatggtaaagccaaccactgaccttgtatcttcatcatcagcaacaacaaaacctgatattccaagctccaaagtacagtcacaagctgaagagaaaacaacccctcctctaaaaacagactctgccaaaccctcacagagttttccaccaacaggggaaaaagtcaccccatttgattctaaagccatacctcgacctgcatcagattcaaaaattatttcacatcctggtcccagttcagagagcaaaggtcaaaaacaagttgaccccgtac

SEQ ID NO: 416744 - DNA, 374 bp, Homo sapiens
tgaagttctttcttcagcgtgttcaattctattgctgagagtttccagagccttttgcatttctataactgtgtccattgtttcctgaagttttgattgttttttatttatgctatctatttcattgaaaatctctcccttcacctgttgtatcatttttttgatttccttaagttggactttgcctttcactggtgccttcctgattagcttaataactaaccttctgaattctttttcaggtgaaacagggatttcttcttggtttgcatccattgctggtgacctagtgtgattttttggggggtattaaggaaccttgttttgtcatattactagagttgggtttctggttcctcctcatttgtgtagtg

SEQ ID NO: 416745 - DNA, 272 bp, Homo sapiens
aggtaggggattttattggaaatacggatctagagctagtggaagtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416746 - DNA, 1050 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416747 - DNA, 1608 bp, Homo sapiens
  misc_feature (1059)..(1059): n is a, c, g, or t
  misc_feature (1061)..(1062): n is a, c, g, or t
  misc_feature (1064)..(1064): n is a, c, g, or t
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagcaaaaaaaanannanaaaaaaaaaaaaaaaaaaaaaaaaagggggggcgcagcacatacaaaaagttacccccggaaggggccacaaatataagcctcgatcaccagaatttgtgttgaaacgaaggtgggcaccccaaaaagagagcatgtgacatataaaagcacagagcagaaataaggagacagataaaattaaaaacagagtcgacgatatgatgaaaaaaaatcggacccaatcagagggaagaacacatttaggagagaaaggaagagaacccaataaaacactaggggaggaggagagggcaacacacaaaataaaagttggggcaagaaagaaaactatcacaaaacataggaagatatatagaagacagcagtataaaggggccaaaaattaataaacaatttagaaaaagatgaataaaaaagagattggtgaaaaaaacaaatagggagaaataaatagtaggcagtagagataaaagaagttggtaaaagagaggaataattatatagaacaaaattatataccacggaagaaggtaataatagtg

SEQ ID NO: 416748 - DNA, 1028 bp, Homo sapiens
  misc_feature (917)..(917): n is a, c, g, or t
  misc_feature (919)..(919): n is a, c, g, or t
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggaccanangtgcccgcatccggaccaggaatgtcacggcaagagtcagagaattacccggacagcaagctataaacgagaactaacctgtgccaaaaaagtacgaagcaaaaaaagc

SEQ ID NO: 416749 - DNA, 686 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaagccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416750 - DNA, 933 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416751 - DNA, 942 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgagtgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416752 - DNA, 799 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416753 - DNA, 742 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgacccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416754 - DNA, 556 bp, Homo sapiens
ggcgtgcgcagccgcagagcgccgcagcctcgccagctcgccccggcactgcgcacttgccagccagtccgcccgtccggagcccggctcgctggggcagcatggcggggtcgccgctgctctgggggccgcgggccgggggcgtcggccttttggtgctgctgctgctcggcctgtttcggccgccccccgcgctctgcgcgcggccggtaaaggagccccgcggcctaagcgcagcgtctccgcccttggctgagactggcgctcctcgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416755 - DNA, 654 bp, Homo sapiens
tgtctctctctctctctgtgtgtgtgtgtgtgtgtgtgtgtgtgtgtgatttcgtttgtgtttgagagggaatggtcttcgcatctccgtgtgcacattccatagtggttctgttggaccaagtgcctgggatttcgtttgcgtgttcctgagactgtttctctccgtttctttgtggagctgtgtcatcctgaggagaggagccatgatgtctctctgctgcattgtgtctttaaggatggtgcatgtccttgcacctgggtggcttggcgattgtaactgcaggagcagctgcggatgtgaacgtgtgcaggagccccgcggcctaagcgcagcgtctccgcccttggctgagactggcgctcctcgccgaccacgatgtgggctctgagctgccccctgagggcgtgctgggggcgctgctgcgtgtgaaacgcctagagaccccggcgccccaggtgcctgcacgccgcctcttgccaccctgagcactgcccggatcccgtgcaccctgggacccagaagtgcccccgccatcccgccaccaggactgctccccgccagcacgtccagagcaacttaccccggccagccagccctctcacccgaggatccctaccccctggccccacaataaacatgatctgaagcagc

SEQ ID NO: 416756 - DNA, 289 bp, Homo sapiens
aggcatgagccactgtgcccagcctagaagcaacttttgaaaagataatagctgaggactttcaaaactggtgaaaagcattgtcacagattaaaaaacccaagcagaatttaaaatacacaaaaaacccaggcacattcatagtaattgataaccaaagataaaatcttataaaatagctagagaaaaaaagacatcaccatcaaaagagcaaccactagacttactgctggattctccagagaaataatgaaacccagaagacaaatggaatattttcaaagtgctg

SEQ ID NO: 416757 - DNA, 772 bp, Homo sapiens
gaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgacacagccaagagtcttattctacatct

SEQ ID NO: 416758 - DNA, 839 bp, Homo sapiens
ggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttaccatgagaaaagtttgggtgtcttctgttggtcatagttttacatctgattttacagaatggattattgattttttggaagttgagactttaaaaaaaatagatcttacttgcgaaatgcgatggttgctgggaatacctgaaactgtggattatattgcttgacttctacctcagaatcttctttgtttcatgacttaatagtgctttaagtttggtatattatttgacctctaggaattctttgttttacacagaaataaaaattttaaaatagaaaatgcttttactttgtaaggtaagagagtatccatatgcttagatgtgctcgtttctaaaattctagaggttgatataatcagctcatgaatgcacagctatgctttttgtgatagattgtacataacatcagcagttgaaaggtaaaacaattgctttttttttttttttgcatttgttaagtgactatggtactttgtgattccttaatctatagatgagtcagctccacacttgagtctctttttagagggaaatcagtaataaagctgtaaaataaggaaaaaaa

SEQ ID NO: 416759 - DNA, 274 bp, Homo sapiens
ggaatagcagagctggtgggaaccaaagaaacagaggcaatcggttgcaagacaacagacagttcagaggcagggacaacagatgggggtggccaagtgacaatcgatccaatcagtggcatggacgatcctggggtaacaactacccgcaacacagacaagaaccttactatccccagcaatatggacattatggttacaaccagcggcctccttacggttactactgatagaaatgttggcagcttttagtaaaagcatttactctgttacc

SEQ ID NO: 416760 - DNA, 749 bp, Homo sapiens
ggaatatgagaaatgtcacctcctggctaccacaataatgcaactaggagttctggttctccgctgactacccacaggagtccttagaggaaccacacaggaaacctgggaaacctaacactctgattccaaggctccaagcttgatatagaagactatcatatgaaccagaaagggtaactgaaaccaaggaaatgactccagtatcaagctaaagacatgccttaaaggatgaggaggagcagaaatcttaccagcaaggcaagaaagaagccgtacgtgaacagcctctgctttaggcccagaaggaaaagaagcttacaggagacaatcagtcttacactcttccatggtcacaaacaagaggtccctggatctacaggtcatcttgcccctgaaatggccctggaaagctatggctgaagaatggaggaaaagatgactttctctgtttcttcagaccaggcatcaactgggatgttggaatgttgataaaaggacatctcatcctttgttttctgcctatgctttcaccatacccattcccatgtctggtcatcacagcgtccttcacagcccttagctgaatcatgttgagtacaggatggtgtgaatatcatggtttgaatgcaaccatggtctgtccatgtggcttgttttttgcagcccacttagacttaagccctcttaatttcaaaattatgttcatatgtgccaataaagttgtccctacatgaactgaaaaatgc

SEQ ID NO: 416761 - DNA, 897 bp, Homo sapiens
  misc_feature (1)..(1): n is a, c, g, or t
ngagagggcctcctaggaggcgggtgggcaaacggagacctacgcctcggggtctcccggtgccccggctgggtcccgcccgccggcggaggggcgcgtcctcactcaccggttccggtggcgccgctctcccggggcgcccagcacagcgcgagcagcagccagagcgcccagagcgcggacgtgcccatggtgcccgcctggatggtgccgccgccgccgccgccgccgccgttcgctccgcacgacaagttaccagcccttccgaaaggaggaagaaggctccaagcttgatatagaagactatcatatgaaccagaaagggtaactgaaaccaaggaaatgactccagtatcaagctaaagacatgccttaaaggatgaggaggagcagaaatcttaccagcaaggcaagaaagaagccgtacgtgaacagcctctgctttaggcccagaaggaaaagaagcttacaggagacaatcagtcttacactcttccatggtcacaaacaagaggtccctggatctacaggtcatcttgcccctgaaatggccctggaaagctatggctgaagaatggaggaaaagatgactttctctgtttcttcagaccaggcatcaactgggatgttggaatgttgataaaaggacatctcatcctttgttttctgcctatgctttcaccatacccattcccatgtctggtcatcacagcgtccttcacagcccttagctgaatcatgttgagtacaggatggtgtgaatatcatggtttgaatgcaaccatggtctgtccatgtggcttgttttttgcagcccacttagacttaagccctcttaatttcaaaattatgttcatatgtgccaataaagttgtccctacatgaactgaaaaatgc

SEQ ID NO: 416762 - DNA, 700 bp, Homo sapiens
ggcgtgcacctggggggtacttgcagtttccaggggcaacaagcatctctctaccaccctctcctgcgcccctgagagaggctggctccaagcttgatatagaagactatcatatgaaccagaaagggtaactgaaaccaaggaaatgactccagtatcaagctaaagacatgccttaaaggatgaggaggagcagaaatcttaccagcaaggcaagaaagaagccgtacgtgaacagcctctgctttaggcccagaaggaaaagaagcttacaggagacaatcagtcttacactcttccatggtcacaaacaagaggtccctggatctacaggtcatcttgcccctgaaatggccctggaaagctatggctgaagaatggaggaaaagatgactttctctgtttcttcagaccaggcatcaactgggatgttggaatgttgataaaaggacatctcatcctttgttttctgcctatgctttcaccatacccattcccatgtctggtcatcacagcgtccttcacagcccttagctgaatcatgttgagtacaggatggtgtgaatatcatggtttgaatgcaaccatggtctgtccatgtggcttgttttttgcagcccacttagacttaagccctcttaatttcaaaattatgttcatatgtgccaataaagttgtccctacatgaactgaaaaatgc

SEQ ID NO: 416763 - DNA, 444 bp, Homo sapiens
tggttcaaagtctaggccctcttcagagctggctgattcagcttgccaacagtgacatcagggtgaggcttcctctgtccacagcattagctgcgaatatcctcatggtcacaagatggctgccagtggccgtcagggtgtgtgcttccttgttcacatccagtggaagagtgacagcctgctccccttagctctctgacaccaatgagaaggtgctaagaacttactagcaggcctttcctcatgacccattcaacaggattgggtcacgtgcctattcctgaaccactaattgggaagggatgggattactcttagaccagtggttctcaactgagcatgagtttgtcttccaggtgacagttggccatgtttggagacatttatggttgtcacaactggggtgatgctactggcatctcatgggtagagccagggatgctg

SEQ ID NO: 416764 - DNA, 1090 bp, Homo sapiens
tctctcctccagtcttttcatgagtgtaggaagtcaaactatgtgagagagaattgtagaaagcatggaagcaattccatgcatccgcagatgggcacctggggaatcctgggtcaggtttccggtgagttgaaaatgatcaaaggaaaacttccttcctcaaagcatcgtaggaggacatggaagcagagtgctggggaggaccaggaaaagccagggatgagatgagacagctataagtaagcaagccccagtgagtgtgaaggattggtagaaatgttactgatgatgtgaaagatttagacagagggattaggtatggtgtatgatgagtttggtagttgaggagcccttattacaggtaatatagcttctcccaagctcacttgcaaactggaaggcttttttaaaaatgggcttccacctatgaagggaaagcatctgctcttacatagttggattaggtcattctgctttatttatatatcaaataagaattaaggtactggtgaacagtagagataaagtaagaattttattgtaacaggttataaaaatattttgataatttcccccaaagagaatgtactatgaataaataaaatctacaaattattgggctaatttacccttgtttcttatattttgtatacttaggaggtgacctctaggaaaaaattgctgaagaggtagtagagcagggtgaagataccgtatactgtcatccctaggtatctgtaggggattggttccacagattgcaaaattcttggattctcaagtcctcgatataagacagtgtagtatttgcatatgacctgcacatatatgggaggccgtatattttaaataatctctagattacttctaatacctattacaatgtaagtgctatgtaaatagttgttatattgtttagagactgacgaaaactgcatgcttaataaattacacaattttttaaaaaaattttctattcgatgttggttgaatccacaaatgtgaaaaccccaggtacctggagtcaactgtgtggtttttttttttttctcctagtcagttaataataaatattcctagtttggaagca

SEQ ID NO: 416765 - DNA, 162 bp, Homo sapiens
tttgttgggtatcattgggtttagaacagggataaaagtgaaaagaaaaaaatgtatatgtgcttctttcactacagcatttgttatgaccttagttaaatgtggcacataattaggtattatttgcagagctcctgaatccacttatgtgtgcaaaatgcc

SEQ ID NO: 416766 - DNA, 268 bp, Homo sapiens
gctggaagacagtagaagagccataggacaagtctctaagagaaggaagaaaaggcgcaatgaaagaaaacaagtttaagatagtagaaaagcattcaaagacggcaacctgaggtaaggtgttttcactgaagcttttggggtaaaacagttttgagttggcatgcctgtagacatgggaagcagcagtgatgcagaggtgaacattactgtagataaaaacggatgggaatttgacttgctagggactgaggggttaatcatataa

SEQ ID NO: 416767 - DNA, 797 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 416768 - DNA, 906 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacgaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 416769 - DNA, 916 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 416770 - DNA, 1025 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccgaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 416771 - DNA, 934 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatgaaaaagaaaaaaaaaaatcggggttctttgccggggggggaaaagggtttgaaagggccgtgcctttgttccggcccctttttgtcaaggggaatcggccggcccaaggggggtaaatgaaaccgacgagttgcaac

SEQ ID NO: 416772 - DNA, 815 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacgaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacaggggccccggcatcttccggaacaaggggggcccccttggccggggggcccggccggggccgtcccg

SEQ ID NO: 416773 - DNA, 666 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggccatccccacccaggggggtgcgggaatccccctaccccgccaagttttgtaaaaaaaaaagggaaccccccaatttcccaaa

SEQ ID NO: 416774 - DNA, 371 bp, Homo sapiens
ccctcagtctgggttcaaggaaagagggggaggcaggttttttgatccagtgctgtccccacccccacccctgtgctgttgaggatgcagaaagaccctccctagggcccctctggcctcccaggcatggctcaccttctcctctgctctccctgccagctttacctgctgttcctgagccttacgctggccactgtcaacgcccgttctctctccacaccaccccccaaaaatttttgccgctccaacacttcaacactattttgttttatttgtcttattaatataagaaggcaggaatgtcaggcctctgagcccaggccaggccatcacatcccctgtgacttgcacgtatacatccagatggcctg

SEQ ID NO: 416775 - DNA, 1399 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagatttagggtttcctcggggctttcgggatcttcacctaatatccggtattattttatgagaggagtggtcttggctgtcagaactggatccctggggtgatatttgggaattagtggagtgatctctgaagacctagggctatgatctggagctgctgtggctgaaatttggggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggtagggaccctcagcttggatgtcatgggtacctggggtggggatggaaataagaggggaaccgggaagtgccctaacacccctgtggtccccataccctgcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 416776 - DNA, 1089 bp, Homo sapiens
  misc_feature (859)..(859): n is a, c, g, or t
  misc_feature (928)..(928): n is a, c, g, or t
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatgcgagcaatactgtaagaacaaagcatgatcttggtactgggatattttaaatatccacagtnctcactttttccaaatgatcctagtaattgcctagaaatatctttctcttacctgttatttatcaattnttcccagtatttttatacggaaaaaattgtcttgaaaacacttagtatgcagttgataagaggaattcggtataattatggggggtgattattttttatactggatgggccaaagctttactactggggaaagccaactgttttaaaaaagattacattcc

SEQ ID NO: 416777 - DNA, 780 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctggctggaaccccgcaccacagctgccatgtgggccctgcaaaccgtggagaaggagcgaggcctgggtggggaggtaccaggcagccaccagggtcccgatccctaccgccagctgcgagagaaggaccccaagtacagtcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 416778 - DNA, 842 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacgaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccagctttacctgctgttcctgagccttacgctggccactgtcaacgcccgctgggtggggaggtaccaggcagccaccagggtcccgatccctaccgccagctgcgagagaaggaccccaagtacagtgctctccgccagaatttcttccgctaccatgggctgtcctctctttgcaatctgggctgcgtcctgagcaatgggctctgtctcgctggccttgccctggaaataaggagcctctagcatgggccctgcatgctaataaatgcttcttcagaaatg

SEQ ID NO: 416779 - DNA, 410 bp, Homo sapiens
cactcgcgatagcgccctgctcccattttctctctcgaactgtctctttctcattcctttgactccgctggacttgccgcccccgtgacctggtgttgggtctcatcatcccaacagattcccattctaaagatgagggaaccaagaggtggaagttcatgccgtggaggaagtggtgaaggaggtggtgggacatgccaaggagactggagagaaagccattgctgaagccataaagaaagcccaggagtcaggggacaaaaagatgaaggaaatcaccgagacagtgaccaacacagtcacaaatgccatcacccatgcagcaaaaagtctggacaaacttggacagtgagtgcacctgctaccacggcccttccccagtctcaataaaaagccatgacatgtgtaaa

SEQ ID NO: 416780 - DNA, 1865 bp, Homo sapiens
  misc_feature (8)..(8): n is a, c, g, or t
ggcagagncgggggcgagggggcggcaggcaggtgtagcgctgccctgggagggcttgcacccccacacccaagtgagcggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagaggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 416781 - DNA, 1159 bp, Homo sapiens
cactcgcgatagcgccctgctcccattttctctctcgaactgtctctttctcattcctttgactccgctggacttgccgcccccgtgacctggtgttgggtctcatcatcccaacagattcccattctaaagatgagggaaccaagaggtggaagttcatgccgtggaggaagtggtgaaggaggtggtgggacatgccaaggagactggagagaaagctgcaggagccagacgtgtggagtcccagcagaggccaacctgtgtctcttcatctccgtgagaaaggtgcccccgaagtgaaagagatggcctggtggaaagcctgggccactgcatctctgtccctgtagcgaagagaagttactgattcctaagctcctactctgagaacacaaatatctgcaatacctcggtttcaaagccacttcaactgcactgggccctgtgggtcactgctgcaccgccctggaccatgtgggtccctgaggagcgacctgccggggccacctggctggacgaaaaagacacagctaggacttaagccgtgagaaaaaaagttcatcagtaagaaacaagtcaatagacaagtaaaagactaggagaaaatatgcataaaacataaaaaagtgacttgattcctgattctggagtattcaagaaattcctataactcaacacaaaagtgcagtccaccaaaatgagcacacaaggcctggggtaaactatgcacaaaggaacgtagacaaatggccagccacacacctgagaaagcggcatacccatccagcaaaactgcccaacaagccccaacctcaaggtactaccaagtgagtaacgcgacacagcacggcaaaccactcgcggacaactcgccaggctcgcacacacggaacacgcacacgactaccgccaatgacaccacccagcggaaggccaaccccgtgacggaataaacactccacagggcataacccgaaggcgtaccaccccccaacacctagccccaccctcgaacgcccgtcaacaccgcaggacaaccacacaagccccacaccccacaacaagagacaacaccggccactccccccacaaacaacaccaccaccgcagaacgtgaccccagcacaaccgcgcccacccacccaacagagaggcgacc

SEQ ID NO: 416782 - DNA, 619 bp, Homo sapiens
cactcgcgatagcgccctgctcccattttctctctcgaactgtctctttctcattcctttgactccgctggacttgccgcccccgtgacctggtgttgggtctcatcatcccaacagattcccattctaaagatgagggaaccaagaggtggaagttcatgccgtggaggaagtggtgaaggaggtggtgggacatgccaaggagactggagagaaagctgcaggagccagacgtgtggagtcccagcagaggccaacctgtgtctcttcatctccgtgagaaaggtgcccccgaagtgaaagagatggcctggtggaaagcctgggactcaggaattctcccactccggaatgccttgctgctggggtgaccaggtcttcacttgtgaaacaggagtcggccacctcagccctgcgcctggcctggtggaacatgggtcaccgccccaacctggggcagccgcccatcccaacgcagtgctgccgctctccatgcctccctgtgcccagctaaccgggggacttgtccctgggaaaaactgggtaccaggctgcctttggtttcagcccctactcctcttccgggctgcctgttctcccggacggcccctttcccggg

SEQ ID NO: 416783 - DNA, 504 bp, Homo sapiens
cactcgcgatagcgccctgctcccattttctctctcgaactgtctctttctcattcctttgactccgctggacttgccgcccccgtgacctggtgttgggtctcatcatcccaacagattcccattctaaagatgagggaaccaagaggtggaagttcatgccgtggaggaagtggtgaaggaggtggtgggacatgccaaggagactggagagaaagctgcaggagccagacgtgtggagtcccagcagaggccaacctgtgtctcttcatctccgtgagaaaggtgcccccgaagtgaaagagatggcctggtggaaagcctgggtaagtgggagctggcaggagatttgggttcctgcatggtgttgggtgctggtcaccagggagtcctggactgggagggcagcggctctgctctgaaccctcaccctggactcgggggcagccggcctgctctgagccctcaccctggacttgtcttctctgttcagttcatgccgtg

SEQ ID NO: 416784 - DNA, 2139 bp, Homo sapiens
cactcgcgatagcgccctgctcccattttctctctcgaactgtctctttctcattcctttgactccgctggacttgccgcccccgtgacctggtgttgggtctcatcatcccaacagattcccattctaaagatgagggaaccaagaggtggaagttcatgccgtggaggaagtggtgaaggaggtggtgggacatgccaaggagactggagagaaagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagaggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 416785 - DNA, 990 bp, Homo sapiens
agcagcttagatctgtcttccacagagaaggtggcttttacagagaaattgacatactcatcacttatctgacatgacccagctttgtaaaactggcttctattaaaatagtcttaatagactattcactgaggaggagagaatcttattcactctttacattctcttcacattttcagaatagatgtttaaatcattgctcacactggatccataaatgtctaaaatgttgatgaagaaataggtgattagagagtaaaattaatagagacttacccttccttgcattttaacataatattctttccccttttccttcctctgttacttggctcttaaataccagaagtgagatatgaaaaagggaactggggacaagtattgaaagcaccataggtttatcttatattagcattttccaaactttataatgaaccagcagtgacccacacatctgccaggtaggaattgctcatcagttgtgtcgcgttatcttgttaagcttcagcaatgttccatacagccactaataacagatcaaagtgagcattagggttgaaattagtaagctgtttcttctcagttctttctggtagttgaataaatatagaatgtattaaatagttttctttatttcagaacttctcagagtctgtaatatattgtatggtggtagcttaggaggaagatgcaataggaaacttttcccagataggttcactattttctttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgtttcttaagtatgtttcaga

SEQ ID NO: 416786 - DNA, 1045 bp, Homo sapiens
ggtagaaccctgcctaatcatatggttctggatggcattgatcgaatccttattctttcattaggaataacaatagaaaaaatactcctgccctactgatttcaggatatgtctattttaaagtgcccatttgacaaaaccattatcagggccatgttttctttttctgcagaaaaatcaaccactctggtcagtagttaggtcttatgacaagcaccataatttccttaggcagagtagaatataataggatacttctttttgaaacataaatgtctaaaatgttgatgaagaaataggtgattagagagtaaaattaatagagacttacccttccttgcattttaacataatattctttccccttttccttcctctgttacttggctcttaaataccagaagtgagatatgaaaaagggaactggggacaagtattgaaagcaccataggtttatcttatattagcattttccaaactttataatgaaccagcagtgacccacacatctgccaggtaggaattgctcatcagttgtgtcgcgttatcttgttaagcttcagcaatgttccatacagccactaataacagatcaaagtgagcattagggttgaaattagtaagctgtttcttctcagttctttctggtagttgaataaatatagaatgtattaaatagttttctttatttcagaacttctcagagtctgtaatatattgtatggtggtagcttaggaggaagatgcaataggaaacttttcccagataggttcactattttctttttccacgaaaaataagctgttctcaaaatacagtttacaaaattttatccttaactcttcactctttctcctagttagggagaccgctccaccagtagaaaagataaaccctggtaatttgttgtgtaaatgggataaatagcctagtacctagtcatgtggattcaggcagcactgagcctaaattaaagtttgcaaggtatacatgttaatgtatctaagttactatatttagcctgtttcttaagtatgtttcaga

SEQ ID NO: 416787 - DNA, 1458 bp, Homo sapiens
ttccgcctgcaccaggcgcttccgccaccatggcttcacgtggggttgttggcattttcttcctctctgctgtcccccttgtgtgtctggagctccggcgtgggatcccggatataggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaa

SEQ ID NO: 416788 - DNA, 461 bp, Homo sapiens
caggctattctcccacttcaacctcccaagtagctgggactagaggcgtgcacccacatctagctaatttttctattttttatggcggggggtgtctcaaactcctggcctcaagtggtctgcctgtctcagcctcccaaagtcctgggattacaggcgtgagccaccaccatgccctacctatgtcttttaataattagcaaagcagtatctaagtcctttttagctgcttagctgttttatggaatgaaaggaattgcaaagagcaatggatcggagttcttatgtgaatatttcttccttaggtagttactgttgctctccgatgtcccagtgggaatgtcctgaggagaaggtttttgaagtcctacagctcacaggtaagtgaaggaattcacattttgagaaatatctttgttgaatatggcagtagtttattcacatgccgtgggggaaggtgt

SEQ ID NO: 416789 - DNA, 1641 bp, Homo sapiens
ttccgcctgcaccaggcgcttccgccaccatggcttcacgtggggttgttggcattttcttcctctctgctgtcccccttgtgtgtctggagctccggcgtgggatcccggatataggtaagtgtgactttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaa

SEQ ID NO: 416790 - DNA, 1518 bp, Homo sapiens
ttccgcctgcaccaggcgcttccgccaccatggcttcacgtggggttgttggcattttcttcctctctgctgtcccccttgtgtgtctggagctccggcgtgggatcccggatataggtaagtgtgactttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaagggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaa

SEQ ID NO: 416791 - DNA, 1335 bp, Homo sapiens
ttccgcctgcaccaggcgcttccgccaccatggcttcacgtggggttgttggcattttcttcctctctgctgtcccccttgtgtgtctggagctccggcgtgggatcccggatataggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaagggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaa

SEQ ID NO: 416792 - DNA, 1335 bp, Homo sapiens
ttccgcctgcaccaggcgcttccgccaccatggcttcacgtggggttgttggcattttcttcctctctgctgtcccccttgtgtgtctggagctccggcgtgggatcccggatatagaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaa

SEQ ID NO: 416793 - DNA, 1164 bp, Homo sapiens
caggctattctcccacttcaacctcccaagtagctgggactagaggcgtgcacccacatctagctaatttttctattttttatggcggggggtgtctcaaactcctggcctcaagtggtctgcctgtctcagcctcccaaagtcctgggattacaggcgtgagccaccaccatgccctacctatgtcttttaataattagcaaagcagtatctaagtcctttttagctgcttagctgttttatggaatgaaaggaattgcaaagagcaatggatcggagttcttatgtgaatatttcttccttaggtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaa

SEQ ID NO: 416794 - DNA, 1667 bp, Homo sapiens
ttccgcctgcaccaggcgcttccgccaccatggcttcacgtggggttgttggcattttcttcctctctgctgtcccccttgtgtgtctggagctccggcgtgggatcccggatataggtaagtgtgactttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactacgcaacgaaaaagttctcttctcgtctccgttaatgattacaaaaatgaacactaacccaaca

SEQ ID NO: 416795 - DNA, 1655 bp, Homo sapiens
ttccgcctgcaccaggcgcttccgccaccatggcttcacgtggggttgttggcattttcttcctctctgctgtcccccttgtgtgtctggagctccggcgtgggatcccggatataggtaagtgtgactttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaagcttcaaagctcttggaggctttaaagttctttctgttgggtgtgcattacagtttacttaactgatgtttgcgatttatataattttgccttgtattaaatgttacaaagttccaaatgaatcagtattttaaaaaataaaactatgcggccgacacgacgcacgtacgtgacccacaggaacacatggtgaccgc

SEQ ID NO: 416796 - DNA, 1648 bp, Homo sapiens
ttccgcctgcaccaggcgcttccgccaccatggcttcacgtggggttgttggcattttcttcctctctgctgtcccccttgtgtgtctggagctccggcgtgggatcccggatataggtaagtgtgactttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgatttacctgaagaaccttctcaaacagcagaagaagtagttactgttgctctccgatgtcccagtgggaatgtcctgaggagaaggtttttgaagtcctacagctcacaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacaccataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcacagcattccacctctcacgcctcccgcatgccccccctctcgtctctctcctcggcgacccccgagccgccccacaccccacacctctctccggacgctttaaagttctttctgttgggtgtgcattacagtttacttaactgatgtttgcgatttatataattttgccttgtattaaatgttacaaagttccaaatgaatcagtattttaaaaaataaaactatgaaagcattaaaatataggtgaatttttaaaaaaaa

SEQ ID NO: 416797 - DNA, 866 bp, Homo sapiens
ttccgcctgcaccaggcgcttccgccaccatggcttcacgtggggttgttggcattttcttcctctctgctgtcccccttgtgtgtctggagctccggcgtgggatcccggatataggtaagtgtgactttttcccttcgacagtcacagctgggtaattttcacaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttggggctgagtctcactctgtcgcccaagttggagtgcaatggcaccatctcagctcaatgcaacctctgcctctcaggttcaagcaattcttctgcctcagctaatttttgtttttgagacagagtctctctccatcgcccaggctggagtgcagtggtgcgatctcagcttactgcaacctccgcctcctaggctcaagtgattttcctgcctcagtctcccacgtagctgggattacaggtaactgccac

SEQ ID NO: 416798 - DNA, 351 bp, Homo sapiens
cctaatttgttgttttcaacaggccagcagatacatagagaatgttttaaaacctcaccaggaaatgaaattgagaaaactggaggagcgcttttatcaaatgacgggtgaagcctggaaattaagcagtggtcacaaacttggggttggaaaatattctcattttatattttgaatcctcttactatgtttcctattacatgattgatttttaattgaaaatgatgttagactgcttttaggagtttttattgataatgattatcagtttttgttcagcatacttgtttattacatggttaaggggttggtcgttttttttttttttttgagatggagtcttgctttgtt

SEQ ID NO: 416799 - DNA, 320 bp, Homo sapiens
cctaatatgagtgactgctgcttcctcggcagtcagccttagcctcggtctagtcctccctctttctaaataagactgatgaagacacccagtcagaattacccccacttcctggcagcatccaattctgaacaaagctccagatctgtaaatgctccccaaaccacctatcaccagcccaaagcctataataggttctttttaacacccccttacagagacgcctgaaacttccctatggtatgaaggagtgacaacaatgtttgttcaaccccaggtggactcctggtggcctttttctggaggacattggccaaatg

SEQ ID NO: 416800 - DNA, 105 bp, Homo sapiens
gaaaaccaagttctcttcctcaaagaggtttcctcaagtcagaaccctcaaagttgcatgtgcggaccacattcgcttgtcctaggaagaatcactttccaccag

SEQ ID NO: 416801 - DNA, 342 bp, Homo sapiens
cttgcttgatttttccctgtgtgtcagagaatgtgcacattgaaagagagggagctctccatcaccaagagagcccaaaaatagcccaactgatcatagccattgtaaaaatattcatggatgtaaggaaagatcctttcccagtctgatgctccttgacttgtgatttgctaaatttgagaagccatcacttacacaacctgttttatagacaaatccttccagtttcagaagaaaaaatgtcatctatctcaacctccatctctttttcaaacttcgatagatgagaagaaaatggtgaataaatttttagaatcagttttgcaagattggtttcaagga

SEQ ID NO: 416802 - DNA, 936 bp, Homo sapiens
cctggagctgcacctgcttctgggcggacgcacttggcgcgcggcgcgggctgcagacggctgcgaggcgctgggcacagcacccagaagaatcctgtatttaattggctcatatggaaaattttagaaagagagagacagcagggctgagactatcttctgctcaggaaccaaaacgagctgggaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactggtatgtctgagacttcagtgaagct

SEQ ID NO: 416803 - DNA, 920 bp, Homo sapiens
cggtgtggacgtatgtgcgcacatacacatgcgggtacacacaatgccccagctggttgaatgccaccatgcaggggatacacccctttggttaagcgaaaccacactctaccttttgcccagggaggtaccgtcttgcctccatcacaagcctcaggagacccactccactgccaggggagcgctgccagtatgactcacactgactggggtatgaaaatacattttgtcatctaacaacctcacttctgtacctcagcaagagtcgaaaaaggttgagggcaaaactgaatttcaagtatacacacacagtctgttacaaatcagcaacatgcttcagccggcccatcctatactgaccccaccatgggttccatagagattttaagatacaatcccttgctgctttatactcctaacatactcatgaaatacacttactcgcatctgtttgctgcctgtaatgttatgtactaactgcctaaatgctgaagaacctagctgagacaggtgtaggaggaaacttcggtgatggtgaaagccaagcgtagccctgacagctgccatctggtttgtggcaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcaggtgattttccacacccaggcccctcgctggtctggatggagaagcccccaccgagcgcatcccagagaaatccctgacgagaatatggggtctgaaaatgcagcattaacatgccatgcaaaggggtttagatgacccttttccccccatgccc

SEQ ID NO: 416804 - DNA, 2253 bp, Homo sapiens
cctggagctgcacctgcttctgggcggacgcacttggcgcgcggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtgaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacatcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaaggagtttacagtcaaacaggagagacatgcctgtagttacatccagtgtgatgggtgctgagaggcaagtacaaaccacgatgagaaaaaggagaggagggg

SEQ ID NO: 416805 - DNA, 2431 bp, Homo sapiens
cctggagctgcacctgcttctgggcggacgcacttggcgcgcggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtgaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacatcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaaggagtttacagtcaaacaggagagacatgcctgtagttacatccagtgtgatgggtggatcatgaggtcaagagatcgagaccatcctggccaacatggtgaaaccctgtctctactaaaaatataaaaattagcttggtgtggtggtgagcacctgtagtcccagctacttgggaggctgaggcaggagaatcacttgaacccagtaggcggaggttgcacagtgagccgagattatgccactgcactccaatctggcaacagagtgagactccatctc

SEQ ID NO: 416806 - DNA, 2585 bp, Homo sapiens
ttgcttttgtcacccaggctggagtgcaatggcgcgatctcggctcactgcaacctccctctcccgggttcaagcgattctcctgcctcagtctcccgagtagctgggactacaggctcctgccaccgcgcccggctaatttttttatgtttagtagagacagggtttcaccatgtttgtcaggcttatctcgaactcctgacctcaggtgatctgcctgcctcgccctcccaaagtgctgggattacaggcgtgagccaccgcacctggcctctcatgtttttctataagcagttaagagaagccacacagcatcctgaacactttgctttctatctcttctgccaaatatcctaggtcatcattcttaagttctgccctccatgaagtcctaggaaacgacataattcaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtgaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacatcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaaggagtttacagtcaaacaggagagacatgcctgtagttacatccagtgtgatgggtgctgagaggcaagtacaaaccacgatgagaaaaaggagaggagggg

SEQ ID NO: 416807 - DNA, 1732 bp, Homo sapiens
cctggagctgcacctgcttctgggcggacgcacttggcgcgcggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtgaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagcctggttttattgaggataagaaaaaaacattcttcgtttttggaaaagggcttttcaacctttttaattaatgggcttgggaaagcccaaaagggattat

SEQ ID NO: 416808 - DNA, 2361 bp, Homo sapiens
cggtgtggacgtatgtgcgcacatacacatgcgggtacacacaatgccccagctggttgaatgccaccatgcaggggatacacccctttggttaagcgaaaccacactctaccttttgcccagggaggtaccgtcttgcctccatcacaagcctcaggagacccactccactgccaggggagcgctgccagtatgactcacactgactggggtatgaaaatacattttgtcatctaacaacctcacttctgtacctcagcaagagtcgaaaaaggttgagggcaaaactgaatttcaagtatacacacacagtctgttacaaatcagcaacatgcttcagccggcccatcctatactgaccccaccatgggttccatagagattttaagatacaatcccttgctgctttatactcctaacatactcatgaaatacacttactcgcatctgtttgctgcctgtaatgttatgtactaactgcctaaatgctgaagaacctagctgagacaggtgtaggaggaaacttcggtgatggtgaaagccaagcgtagccctgacagctgccatctggtttgtggcaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtgaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacatcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaaggagtttacagtcaaacaggagagacatgcctgtagttacatccagtgtgatgggtgctgagaggcaagtacaaaccacgatgagaaaaaggagaggagggg

SEQ ID NO: 416809 - DNA, 2228 bp, Homo sapiens
tcttatttccagacctgccctccctgcttcccagaaatgatgtgacagtcaaaaaataaaccagagcagaatgttaagacaaactgcactccacccctcactgaaggctccttagaggtatatagataacagctatggactcctatgcacttgctgcgccccaggcccagtggaaagcagctacactctattatcccatttaatcttcactgctttatgaagtatgcactgttattttttacaggtggagaaaacaaggcttcaaaaagctgagtaacttgaccaaggtcaccccactaataaatggcagagcctctcagtgcaagggtgaattttagcaaatggtattaccagttctatttgctgttcggctgcctctaccttttcttctaggtcatttctctagatcccaagcagaatattaggttggtgcaaaagtaacggtgatttttgccattatttcatccagaaagagttccacacggaccaaagagaagggagctcaagtcagtttcttttagttctcctgcccagccactgaaacagtaaaccaagataggcaagaccttggcctcaattatgacattcagtagtttccaccatcgcccctttatctactgatgaatatttcctaagaagtctagtttatagacatgtaatcacagtatttgatagaaatataaagaaaatagtttaagaatcagtagatgccttcacatccttggtaatggattaagggaatctctggctaattggctcttactctttctctattaaagccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtgaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacatcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaaggagtttacagtcaaacaggagagacatgcctgtagttacatccagtgtgatgggtgctgagaggcaagtacaaaccacgatgagaaaaaggagaggagggg

SEQ ID NO: 416810 - DNA, 1225 bp, Homo sapiens
ttgcttttgtcacccaggctggagtgcaatggcgcgatctcggctcactgcaacctccctctcccgggttcaagcgattctcctgcctcagtctcccgagtagctgggactacaggctcctgccaccgcgcccggctaatttttttatgtttagtagagacagggtttcaccatgtttgtcaggcttatctcgaactcctgacctcaggtgatctgcctgcctcgccctcccaaagtgctgggattacaggcgtgagccaccgcacctggcctctcatgtttttctataagcagttaagagaagccacacagcatcctgaacactttgctttctatctcttctgccaaatatcctaggtcatcattcttaagttctgccctccatgaagtcctaggaaacgacataattcaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgctttttgacttcggatgaagagacacggaaggtgggacactcctctttattccacttgagctggtttgagtttcgaggttgttgagggt

SEQ ID NO: 416811 - DNA, 356 bp, Homo sapiens
ttcctcccaccccagtcccacctctggattggcaagtagctggggctttgaggtcagatcaaattgatcaccagcttcatcacttcccagctgtgtggccctgccaagtttctaccttctctaagctactcattaaaaatgctagtaacaatgggacccagctcctaaagttattgtgaagattaaatgagatcatgatattaatcactttgtacaaaacctggcatgtagtacatatttagcaaatactggctaatgttcatatttatgttaatatcaataattatagttgatattattattgtattttggctaaggcaatgtttatctatttgttatctgaaaaggaaagtatc

SEQ ID NO: 416812 - DNA, 199 bp, Homo sapiens
acccttacacagcagcactccctcgggaaccctggggacagagcacagccctggggacacggcagcagccgggtgttcttaaggggtcttcctattagcctgctctccccactgcctggcggtgcctgtagctcttgcctgttagaggggagcctggaagggctgctgggggctttgaagccgttcccaagcactctga

SEQ ID NO: 416813 - DNA, 2158 bp, Homo sapiens
agcgggagagcgcagcgtcgaccctttgtggacgccgagtggcggtcgctcgccccgccccgcgccgtcgggcgctccttcctcagcggcgggaagctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaatctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 416814 - DNA, 2520 bp, Homo sapiens
agcgggagagcgcagcgtcgaccctttgtggacgccgagtggcggtcgctcgccccgccccgcgccgtcgggcgctccttcctcagcggcgggaagctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaatctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaatgggaatgtggtgttagttacgaccacggcctgaccctccagcaacctttctgcaggatcagttctgctgtattatctggtggtgctttctaaggtggggaaaggaattgcacttggctgcattaaatggacgctgggttacttttatttccccccccacagggttgcagagcaaattctttttacattgttcagcgcccggctggggttgggggtgtccacgacctctgacagcccccgatgtcgaaagttaatcctcatggaccctagtttaaagggtatgtgttttataggaataaatctaaagcactattttgtttctgtatagcatttttatcttttagaaacatcatttgttcagc

SEQ ID NO: 416815 - DNA, 1632 bp, Homo sapiens
agcgggagagcgcagcgtcgaccctttgtggacgccgagtggcggtcgctcgccccgccccgcgccgtcgggcgctccttcctcagcggcgggaagctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaatctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacactgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 416816 - DNA, 2214 bp, Homo sapiens
  misc_feature (2159)..(2159): n is a, c, g, or t
  misc_feature (2162)..(2162): n is a, c, g, or t
agcgggagagcgcagcgtcgaccctttgtggacgccgagtggcggtcgctcgccccgccccgcgccgtcgggcgctccttcctcagcggcgggaagctggcggcagcggcggtggcggtggctgagcagaggacccggcgggcggcctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaatctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaanaanaaaaacaaaaccaaaatgccccatgaaaacaagaagcccacaacaaaagaaa

SEQ ID NO: 416817 - DNA, 2051 bp, Homo sapiens
gctaggactgcagggaggggtgcgaggctagccacgcaggcggggccctgggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaatctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 416818 - DNA, 2034 bp, Homo sapiens
caacctcaggctacagtacaggcccggtggtaacgacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaatctgtgccgctcagtcctcattgccaacacggtccggcagatccaagaggagatgacgcaggatgggacgtggcgcacagtggcaccccaggctgcagagcgggcgccgctcgaccgcttggtctccacggagatcctgtgccgtgcagcgtgggggcaagagggggcacatcctgctcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 416819 - DNA, 1911 bp, Homo sapiens
  misc_feature (21)..(22): n is a, c, g, or t
cacatcctgctcctggcttgnnggacggcgggcggctcgcgggtcaggacacaatgtttgcacgaggactgaagaggaaatgtgttggccacgaggaagacgtggagggagccctggccggcttgaagacagtgtcctcatacagcctgcagcggcagtcgctcctggacatgtctctggtgaagttgcagctttgccacatgcttgtggagcccaatctgtgccgctcagtcctcattgccaacacggtccggcagatcctggcttgggggacggccacacacagggtccagtttctgacctttgcccagtcacctcagcacaggcaccaaggcacctgcagagcagcgcctgggagatggatggccctcgagaaaacagaggaagctttcacaagtcacttgatcagatatttgaaacgctggagactaaaaaccccagctgcatggaagagctgttctcagacgtggacagcccctactacgacctggacacagtactgacaggcatgatggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 416820 - DNA, 1502 bp, Homo sapiens
catcgcagcccgccttcagatgtccgagcgcagcatcctcagccggctggccagcaagggcacggagcctcaccccacagagagagcgtcgacgctctctctgtggggggtgccaggccgggcccctgcgaagggctcgagggcttggctccggccaccccaggccctagctccagctgcaagtccgacctgggcgagctggaccacgtggtggagatcctggtggagacctgagcaggagccctgagtgctcacagccgcctctgacgcattgacacgtgagcactggctcccacggagggtgcgcctgccgccagcggcccagccttgctgccctgtctgctgattctgagaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 416821 - DNA, 1202 bp, Homo sapiens
ggcccaagcctttgacttggaccctgatcctggctggaattttctgaacgaaaaaatcccagaacagcccattaccagtggggctgcagccctaggcccgtcccactcacctcccccctgtggagggccaggcagaggctgttctggaaggcttcttgtcttctgacgtccccacagccctgggcccctcgtgtctctttgtgtcccccactgtagaggacggtgagccgcagctgcatcaacctccttttacctttagataggtgaatttttacaattcagttttacatgttttgggcagtattttgtcttaagatatattttttaaactttttataccttatctctttagattttttcagctattttcttaaaagtatattttttctataaacatcctttgctgctacattagaacttttatagcctaaacaattgcagttggtgtgtttcatttttttaaggtttaaataagggttttttgttttgttttgttttttgcagtgagcatcactacagtctcagtcaacagtgtgaatgtatcatgttttactttaaatgtgtgtgtgatacttcttcattatgtcctgcgctgcagtgagacctgggtgaaaatcaggaaccgcacacagccacatcttcctagacctaagagtaaattatggaggattttatttatgtctatttatatgtaaatgtcattgaagacaaaggtcaaatatttgtctgtttgtagatcacaggcaccagttggtcttcagggacctcatagcccctcggtggtgccttctcaaggcagtgttcctggaggctcccgtcagggtcagcccatgcacctgccctgggtgaggaagtagcattgctgctggatgagaaacgcctgcgctgctctgttagactggtgctgaaacaaaaggttaaggctaggttgaagtctagaatgaaagaaatctgaatccatgtcattcataaccccttgatctgtagtgtcatgggtgctgccgcaggcagggagtgagctgggggtgcctgcagccttccactcctgccccgcctcaccccacatgctccctgtttctcatgctttctctaacttcctcaccccttaaccaaaaaggtgtgttttcttttgtgcatatagccattcttaaatatcagtgatgtaaacctcactttattaaaaaattatccagcaaacaaaa

SEQ ID NO: 416822 - DNA, 381 bp, Homo sapiens
atcctggtttgtaacaaataatggaatcttagaattttagaaattgaaatgttctcagagaccatgtggtccagatctctcattttacaggtgaggcaagtggtccagtgactcatctgtgctcactgcatgagagccatgcaagctctagagagcacacacagagtgagagagacaagccgagatcctgtccccgtaggcactagtgtatccatggtttggtacaacattgggtgtcatcctggttgtcccaagcctcagcagccggtggatgtcaataaggtcacattattaataaaaataagaatgaataggccgggcgcggtggatcacgcctataatcccagcacattgggaggccgaggcgggtggatcacctga

SEQ ID NO: 416823 - DNA, 324 bp, Homo sapiens
gggaaacaagcatccccacaggctgtatatgaagatgcaaatttgttaaacatctgtccagatttaaaaggcagataccctttgacccagccatttcccttttaggaacttaacagataggaatttgcaaaaataaaaaagcaatgactggataaggatttccattatagcgctgtttataataacatcaaaacaaaataaaacaaaactgggctgggcgtgatggctcatgcctgtaatcccagcactttgggaggccaaggcgggcggatcacgaggtcaggagttcgagaccagcctggccgacatagtgaaattctgtct

SEQ ID NO: 416824 - DNA, 289 bp, Homo sapiens
gacaccttgtctctaaaatgaaaattaaaagggaaaacatgatcctccagaagctgaggtggctgcctggggatcacctgctcctgaaagcacagttctggacgactgaccctgggctgcctgccctgccggggggagcccagggctctgatcctcaccctctgcaaggtgccttcctgggcggagccgcccctgccccgtccctgcggccaccacctaatttattgccgtgcgtcctgctgctgtgactgcttttgtacctttgcaataaagaattttctggtttcag

SEQ ID NO: 416825 - DNA, 2044 bp, Homo sapiens
ggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggactcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgcgagccgccggccgggggccgccacataagacctgcaaggtggtgcctggggccctggctccttctcggctgcccctgcccacccagtaacagcccccaccagctacagagcccaggcgggtgccagccacgctgggagggcagaggacagacagccccggggctgcgacttggttctgtgtctactgttagaagttgagtgggaagctgcaggcccgccaggaccactgggtccctacagagcaaaggcctgcgtgttcccaaacagccgttgcccccgtggccgtggtaggtaatccatattggatgtcataaggaccagggggatatttaaagagagaaacagaaaatatatagagatataaaattatattcacagtttatctacagatttttcgtaacaatctttcttttccagtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaagaaaaagacgagggactctttgtcacgtgggtttgttttctgtctccgtgcctccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcag

SEQ ID NO: 416826 - DNA, 1914 bp, Homo sapiens
ggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggactcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgcgagccgccggccgggggccgccacataagacctgcaaggtggtgcctggggccctggctccttctcggctgcccctgcccacccagtaacagcccccaccagctacagagcccaggcgggtgccagccacgctgggagggcagaggacagacagccccggggctgcgacttggttctgtgtctactgttagaagttgagtgggaagctgcaggcccgccaggaccactgggtccctacagagcaaaggcctgcgtgttcccaaacagccgttgcccccgtggccgtgtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaagaaaaagacgagggactctttgtcacgtgggtttgttttctgtctccgtgcctccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcag

SEQ ID NO: 416827 - DNA, 1020 bp, Homo sapiens
ggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacgtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaagaaaaagacgagggactctttgtcacgtgggtttgttttctgtctccgtgcctccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcag

SEQ ID NO: 416828 - DNA, 1834 bp, Homo sapiens
ggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggactcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgcgagccgccggccgggggccgccacataagacctgcaaggtggtgcctggggccctggctccttctcggctgcccctgcccacccagtaacagcccccaccagctacagagcccaggcgggtgccagccacgctgggagggcagaggacagacagccccggggctgcgacttggttctgtgtctactgttagaagttgagtgggaagctgcaggcccgccaggaccactgggtccctacagagcaaaggcctgcgtgttcccaaacagccgttgcccccgtggccgtggtaggtaatccatattggatgtcataaggaccagggggatatttaaagagagaaacagaaaatatatagagatataaaattatattcacagtttatctacagatttttcgtaacaatctttcttttccagtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcag

SEQ ID NO: 416829 - DNA, 1623 bp, Homo sapiens
ggtggtgtctgtgtgtgtgcacgcacgcctgccatcaaagcagcagggctgagggggtgcagcttgctggtgttcactgggggagggcctgtgggcacacatggcagagagagtggctcacacgtcgtgaggtctcccctgtgctctggtgacccgaggaggtcgtgcagcacagcgcagaagcccctgcccacgggatccggccccccagacaccgaccccacaggccgtcccggatctcagcggacacaggcaggagcgccccatcatttgacggtgagcaggactcaggctgtgtgtcctggagctacttctcaccaactgtggtcagtgcagggggaacgaggaggtcttttgggggcctggcgaggggaagggctgctgcagtctagggagagggggtgcagcctgggggatgttggtggacatggatgtggaggtggaaggaggaggacgttgcgtggagtggtgggaggaggcgggagccgtgtgcgagagcaggtggaaagccttgaggggcaggaccaggatgcagctggcttgtagaagagctcaggagtgagcctggcactccagagggcgcggcgggtggggaggcagcaggcaccagtccaggagagcttcgtggacgtggctcctgcgcgcacacccccaggagcacagccacgggctgcaggtgtggctggcctcagcactcagtcctcacccggagcctttgcctgctcctccttccaagagcactgaggcaccagtgggcttggcactccaccttgggcttccttttcctggagagccgccttgagggtccctcctgtgactggggtctctgcagcgagagccgcgggggttgcggagcccctgcctgggggagctggcggaatgcgagccgccggccgggggccgccacataagacctgcaaggtggtgcctggggccctggctccttctcggctgcccctgcccacccagtaacagcccccaccagctacagagcccaggcgggtgccagccacgctgggagggcagaggacagacagccccggggctgcgacttggttctgtgtctactgttagaagttgagtgggaagctgcaggcccgccaggaccactgggtccctacagagcaaaggcctgcgtgttcccaaacagccgttgcccccgtggccgtggtaggtaatccatattggatgtcataaggaccagggggatatttaaagagagaaacagaaaatatatagagatataaaattatattcacagtttatctacagatttttcgtaacaatctttcttttccagtttgatactgtaaatctatccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcag

SEQ ID NO: 416830 - DNA, 2318 bp, Homo sapiens
aacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttcacatttgttcaggctggtcaagatcttgaagaaaatatggatgaagacgtatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgta

SEQ ID NO: 416831 - DNA, 4088 bp, Homo sapiens
aacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttcacatttgttcaggctggtcaagatcttgaagaaaatatggatgaagacgtatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgtactctgttcgttgattagttgctacaggctgtacctataagatgtacaggataatagttaaatgttgagtattgtacatatgtatttaagtggattgaataactgagtctacatggaggaggaaatgctagagaacagcaggtctaatattttttaagtttactgagagacctttattattattttcaaattaagtatagctttatgtaacttttagccagttgctctgccacagacatagacaaagagagataagatttcacattatccatcactgcataacaaaccacaccaaaactcagtggtttaaaacaaggacttttattatttttcacgattcagtgagttggctgtctctgctgtacagggcctctcagcctccagtagactagacgaatcttctttccatagtagagaaaacatcttaagagagcaagctccaatatgcaagagcttatcgatcctgtacatctatcatatttactaatgttccattggacaaagcaaatcacatggccaagtctagagtcagaatgaggggactacacaagctgacagcggatggtatgactcattgggggccattgatggaacaatcttaccacacaaggacaaattataatttatccttgtggctctctttatttttctaacaacttcaacaaaataatcctgtttatatgttatagtttcttgccacaaattttgttttttcaaacttacctttccaggtttgttttagtatgtatgtacctggaaatttttattactttttataccatttcaagatatgtatcttatataaacctcaagttggattttatattttaataaggaagttaagaccttcatttaagaggcagaagattaagataagaaatataagatagaaaagctttgttcctaacatatcttttgcctgtctgggcaagtatttgactcaactaaattttaatgaacgaatgaatgacagacagagaggaggaaaaaagatgaggattgcatacatgttctaaaccctttgtcagattgcagtttcctagagagtattgaggtgctaggtagaaagttaggaaaggtcctgaggactggtattgacaattggagtcctaatagtactctattcgtattaggaaagagagactagataccaaacatcacgagatcatagagatggaaaactgtatagtaaccaaaaaccaaaacagtgatatttccagaactttttagtattgttgtaaaacttcatgaaacaaaagaccatttaaatagtgaattattaaaaatctttatgatgggaaagtagatctaaattttctctaaaattttccccaaagataatatcctcttagggaacataagaaaaatgtataataaaaatgtggtgcttaattaaccatgactatgtatatattgccaattttagtaatcaatattctttgtgcatgtgatttttttgcatgattaatgttgaattgaaagctctcaggataattaatcctaaatattgtcgcatgttgacctacgttaaaagatgaataggtctagagccgtgatttcaagctattttcctgaaatgcttcagggattccataaacatttaaacaatgttctaaggtacatatacttagaacattgagatatatactacaagtgctaagaatatagtaccttgtatttttgttgatttttatcatgttttaaataggaatttataaaatatttatgatagtaataaagtagtattttatgtgttttgcaaaataagagt

SEQ ID NO: 416832 - DNA, 3712 bp, Homo sapiens
aacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttcacatttgttcaggctggtcaagatcttgaagaaaatatggatgaagacgtatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgtactctgttcgttgattagttgctacaggctgtacctataagatgtacaggataatagttaaatgttgagtattgtacatatgtatttaagtggattgaataactgagtctacatggaggaggaaatgctagagaacagcaggtctaatattttttaagtttactgagagacctttattattattttcaaattaagtatagctttatgtaacttttagccagttgctctgccacagacatagacaaagagagataagatttcacattatccatcactgcataacaaaccacaccaaaactcagtggtttaaaacaaggacttttattatttttcacgattcagtgagttggctgtctctgctgtacagggcctctcagcctccagtagactagacgaatcttctttccatagtagagaaaacatcttaagagagcaagctccaatatgcaagagcttatcgatcctgtacatctatcatatttactaatgttccattggacaaagcaaatcacatggccaagtctagagtcagaatgaggggactacacaagctgacagcggatggtatgactcattgggggccattgatggaacaatcttaccacacaaggacaaattataatttatccttgtggctctctttatttttctaacaacttcaacaaaataatcctgtttatatgttatagtttcttgccacaaattttgttttttcaaacttacctttccaggtttgttttagtatgtatgtacctggaaatttttattactttttataccatttcaagatatgtatcttatataaacctcaagttggattttatattttaataaggaagttaagaccttcatttaagaggcagaagattaagataagaaatataagatagaaaagctttgttcctaacatatcttttgcctgtctgggcaagtatttgactcaactaaattttaatgaacgaatgaatgacagacagagaggaggaaaaaagatgaggattgcatacatgttctaaaccctttgtcagattgcagtttcctagagagtattgaggtgctaggtagaaagttaggaaaggtcctgaggactggtattgacaattggagtcctaatagtactctattcgtattaggaaagagagactagataccaaacatcacgagatcatagagatggaaaactgtatagtaaccaaaaaccaaaacagtgatatttccagaactttttagtattgttgtaaaacttcatgaaacaaaagaccatttaaatagtgaattattaaaaatctttatgatgggaaagtagatctaaattttctctaaaattttccccaaagataatatcctcttagggaacataagaaaaatgtataataaaaatgtggtgcttaatta

SEQ ID NO: 416833 - DNA, 2410 bp, Homo sapiens
aacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctgatactcaagtatcttaatcattctattggatattgtacccatttatctgattgataattagacttctagcaacctccgtcatgtataaccaggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttcacatttgttcaggctggtcaagatcttgaagaaaatatggatgaagacgtatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgta

SEQ ID NO: 416834 - DNA, 2700 bp, Homo sapiens
aacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttcacatttgttcaggctggtcaagatcttgaagaaaatatggatgaagacgtatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgtaaaaaaaaaaaaaaaaaaaaaaaaaaaaaaaaaaaaaaaaaaaaaaaaaaaacttaaataaatttagtcgccaaattcgtcacagagccaaattcaactctaccttactcccagcaaacttttcccaaacaatttacccaaaaatagtctacctgttagaaattgaaaattgtctccaaaaatttgggccctctagggattgccgaaagatttttcccaggcgtatatatccaagggcttaaccccaataccttttcgataatggaattacttcaaaaaagttctctcagggtacgccaaatcttaaaacccccaaatctagccgcttctacctaacagtttattagaccactccgttgtttctcaccccttttggtgcggtg

SEQ ID NO: 416835 - DNA, 1049 bp, Homo sapiens
gattatgattttattggtcataggtttgcaattcatttttaattactgctgtaaccttaaaatttttaaagatgaagaaacccattcccttgtttatttgttttacttatttacttattttattttctggactaagaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtaccttttctctgtcatagtggatcctaaagaaatgccctgcttctgtttgcgccatgatgttgatgccctactctggcaaccacactccagcaaacaagatgatatgtgggagcacatcgcaactttcaatgctttaggctatgtccaagcatcaaagagagacaaaaaattttttgcctgtgctccaaattactcgtatgcagccctttgtgagtgccttcgtcgagtattcatctatcgtcagcctgctcccatgtccactgtactttacaacagaaaggaaggcaggcaagtaggacaggttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgta

SEQ ID NO: 416836 - DNA, 1684 bp, Homo sapiens
  misc_feature (1634)..(1634): n is a, c, g, or t
aacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggagattatgtttaatgaagaacttggggatccttttattataattcacagtatctcactgctaaatgctgaagaacattctatagctaccctacttcttcgaatagagaaagaggaattggatatgaaaggaagtggtttctatgtttctctggagtgggtcactatcagtaagaaaaatcaagataataaaaaatatgaaattattaagcgtgatattctccgtggaaagtcagtgccacattatgctgctattgagcctgatggaaatggtctaatgattgtatcctacaagtctttcacatttgttcaggctggtcaagatcttgaagaaaatatggatgaagacgtatcagagaaaatcaaagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaatagcttggagatttccttgattaagaagaatgaaggactgacctggccagagctagtaattggagataaacaaggggaacttataagagattcagcccagtgtgctgcaatagctgaacgtttgatgcatttgacctctgaagaactgaatccaaatccagataaagaaaaaccaccttgcaatgctcaagagttagaagaatgtgatattttctttgaagagagctccagtttatgcagatttgatggcaatacattaaaaactactcatgtggtgaatcttggaagcaaccagtactttttcatcctgttcatgatatcctcttgtttttctttagcttcctcatatttgtcagctaaacgctcagccatctcgncaggagggttctagtaatgacgtcgtaaaacgagatcttgtgctaggctc

SEQ ID NO: 416837 - DNA, 724 bp, Homo sapiens
aacagagttcagaccttgccgtcgcgcgcgcgttaagtaccaggagaactacatagcccagcatgcaacagtctcaactttttcacggacactacatttcccagaaggcagttcgcaccgcagtgttttctgggatgggaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagctctctcttgagccgctgccttgttaccagctggagcttgacgcagctgtggcagaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttaggaaaaccacgagaggtgtttcgacttcctacagatttgacagcatgtgaaacaaaccggtctttttggtggccatttccttaatttttccccccccaaaaaatttttttttattcccccctttttccccaaaaatttttttttccccccctttttttttttttcccccctttaaacccttggggttaccttgtcagatggaactgg

SEQ ID NO: 416838 - DNA, 4966 bp, Homo sapiens
aggtgcgagtccccactgctggggaggcggcgggccccggctcccctcggccgcctagcccgcctcgcccgcccggggttggcggggagggaacagctgggcggccccagagcccctcggaggacaatgcgcccggcgctcggccaccctcgctcggtctcctccgcgtccggttccttcccgccgcccccggcagccgcccggctgcagcccctcttcctccgcgggggctccttccgcggccggagaggctccggcgacagcagcaccagcaccagcaccagccgcgggggaggcggcggcagacgcggcgggggcggcggctccccgagcagcagcacgggcgccgagcgcgaggacgacgacgagagcctcagcgtcagcaagccgctggtgcccaacgccgcgctcctggggccgccggctcaggtgggcgcccccgccggccccgcgcctgtcgccttctcctcctcagcggccacctcctcctccacctccacgcccacctcctcctgcagcatgacagccgcggacttcggcgggggcgccgcggccggggccgtcgggggccccgggagccgctcggcggggggcgcgggcggcaccgggaccggcagcggcgcctcctgctgcccgtgttgctgctgctgcggctgcccagaccgccccggccgcagaggtcggcgccgcggctgcgcccccagtcccaggtgccgctggggctaccaggcgctgtccgtggtgctgctgctggcgcagggcggcctgctggacctgtacctcatcgccgtcaccgacctgtactggtgctcctggatcgccactgacctggtggtggtggtgggctgggccatcttcttcgccaagaacagccggggccgtcggggcggcgcagccagcggcgcgcacaaccaccacctgcaccaccaccacgccgcgccgcccctgcatctgcccgccccctcggccgctaccgctggggccaaggcacgcggagcccgcgggggcgccggcggcgcggggggcggcctgggggcggccgcggcagcgggcgagttcgccttcgcctacctggcctggcttatctactccatcgccttcactcccaaggtggtgctgatcctgggcacgtccatcctagacctcatcgagctacgcgcgcccttcggcaccacgggcttccgtctcaccatggcgctgtcggtgcccctgctctacagcttggtgcgggccatcagcgaggcgggcgcgcccccgggatcggcaggacccctgctgctgcagccccagcggcaccgcgcggccggatgcttcctgggcacgtgcttggacctgctcgacagcttcacgctggtggagctgatgctggagggccgcgtgccgctgcccgcgcacctgcgctacctgcttatcgccgtctacttcctcaccctcgcctcgccggtgctctggctctacgagctcaacgccgcggccgcagcggctgcatcctggggccaggcctccgggcctggcagctgcagccgccttctgcgcctgctgggcggctgcctggtggacgtgcccttgctggcgctgcgctgcctcctggtggtcagctaccagcagcccctctccatcttcatgctcaagaacctcttcttcctcggctgccggggcctggaggccctggagggctgctgggaccggggcaatcgggcctccccgagtcgggccagagggggctacggtgctccgccctccgcccctccaccacctccgccaccacctcagggaggctcccagctgggccactgcatctcggagaacgaggggggtgctcatggctatgtcaacaccctggctgtggcctctcagaattgagggtgaagggcacgggtccttgtttttgggttgagagtccccaacccccttgtcttctaccttctgtcacctagatttgatcagggtctatttggaagaggtaacccttttcagggctaagggccagggtgtccttctgcaccctggggtgaggacggcttggagggagaccagcagttaacggtgagggaggtaggtgcacttaccctctcctctcttctcctatcctaccccaatcctgacctccaaggggctggtacctctgcttcttgctttgcccacctccactctaattcccatccattaggaggagaggggtgctgggccttggaccttctcccttgcttagaagtgccagcctcttttaggctgtggttagtggccattgtcccatgccttgaaattgacccagaacccactttccactgatgtgtctcttggatttcttccaggtgatagatacaaagtgtatgtctctgtgtgtgtagtgttgttttctcgtgtccaccctgtggccctttgcaatgggtaggagatctggggaggccctgccccctacaccatacttatcaccaccctcctcttttctgcctggatttgtgaccatgaattcccaggaagagctgggcccctgggagctgcccaggtactccccttgaagggagaatctcacccaggatcttcctcaatactgctcctctcttctcagctcagggagaggaggggatccattctctaaggaccaaactgcaccctttcttgggtgagtgagcatttctacctccgtgctttcaacttttgttgcatcatgcactgatgctgcttgcaaaaaatgaagacaaaatactcagaagttgcatttgccatggccactggctccagctggggtttggtgccagtgttattacagggtctgcggagtatcagccattggcttggcctctctctgttcctccctctgcacctagaactcttatccttcctgtggtttggtgccgactgggtcggatctgggcttagagtaatagctttggtgggtttcctggatggatgtgaagttgggcctcccatgggcccaagggagtaggaagccccattccccacctgtccttcctctaggaagtgtagatcagaaagtgaggtggtgacctcccacctctggtctggttaagagtctcactagggccaaggcaggctgcagaactttccctcttcctctcattgagggtgatgacaagagacatccggggactgtgcacttacagtcggtgtggaatgtcactcttgcagtctttgaggcaggataagtatttttacatattttaagggtgcaggaggacagcagctaacaaggccaggaaatactcacttccctccaccctcaacaggatgtggtgggggtgaaacttgaagaatttttgtttccccttctcccttcttacgtttgggaagttttatgtagtgtaacaaactctagacgagttaccagaagatgtggattctagttctgattctgtcactcattggctttgagtgacatatttttatttcctgggcctgttttctcacattaaaaaagtagaagttagatgagtgatctctaaggttgaaggtaatttcagctctcacattcttttgagtttgtggctcttgaaagccctggtcctgatgctccctgtaaaggtggctgggagagaagccagccaggctgcacttgcagaacattccctgctctgtactgggtgtgtgaagccccagcagagaaggccggagggagggcttgggtgcctgggctgggtgtggggcagggcctggcacagctgcagagtgcacagggagggtcagaagtgccaagtcactggccgttaactcagcacccaggccaagcccccgcctcccacttgaagccccctcttacaactgttttgggggcttggagcagaagacacccttgtagacagacataagaggggcagaaggcttgaccagagttctcttgagcctcctcatgctctcagagcagggaacagcgggggaaaatgtttacactccatgcacaatctgtgcttccagtccctcaccctatgtggcccaatagctggctggatttcacacttaattggtatttttttctgccttcttcccctgcccccactgactcctctcctctccctttgattgtactcaaggttctggggcctgggccctgggtgggtaccaacagctgctcgctgttcccatgtcctctctccagctttgctgtgtttctctgctacctaatctcagtgactgtgaaaggacattgtgtctgagccatgcccagccgctggctggccccctgatctgccccccttctattgtttggatggccatctcctgctgggcctccctgactgtaaaatctctgtactgtttgttaggtttttggtgggaggctgtgataagttccaatgagctgccacttccctggatatgtcaagaagctgatggcaacttggccaattctggcagatatcaggcccccagttcagccccagtcaccctcttttacacatgtgggtcaaccactgtgtgctcagagggtcagtcccttcctctgctgtgtttttcttgagtccttgcactcacttcccctgccccagtcacgatgacccctaaagcttcctttgcccttgctttctagggcatccctagtgaaggggcaaacctgagatttctccgtggacctgacagccaaggcagggcactgtctcctgaggccagtgccagcacgtgcatggttcacagaaaaggatcctgggctcagaatctcgagaaccgcctgctcctaacaattcagcaagtcaggggcttcctctctgttagtccccaaatccttacttattttaaaaagactagaccctctctaaagactgttccattttaacatgtcctgattctgcatccgtgggttttgtgaaagagagctagctggcggttagagcctggaagaaggagggaagtggcacctcactagcatttatcacttttttccttctctttttaaaaataaaaccagactctgttctgaaaataaaaaacttgagacttgtaaaaaaaaaac

SEQ ID NO: 416839 - DNA, 311 bp, Homo sapiens
gagaatccgtcttaaaaaaaaaaaaagaaaattatagagggagatgaggtgggacagagtctggcagttcatcagggggactgagaaggtggcatttggaggagaggaggcagtgagctgtgcagtgtccaggcagccacccttcccagcggccaccatgacggtgtcctcattgctttgaccattagtaatcattcattcattcattcatttatccgacgtcagctggaggccctgcccgcggggcatgcgctgagatttgggaggccttccgggatgctgcgctccagcggggaaggccgactggggct

SEQ ID NO: 416840 - DNA, 438 bp, Homo sapiens
atacaaaaaattagctgggcctggtggcaggtgcctgtagtcccagctactcgggaggctgaggcaggagaatggcgtgaacccgggaggcggagttggcagtgagccgagatggtgccactgcactccagcctgggcgacagagcaagactcttgtctcaaaaaaaaaaaaaaaaagaaagacgtcacttcacagattctaaggatttttggagttggataccaggaaaccggaagactaaatgtatacatatttcacaacatcacaattactgtgacagttttttttaaactatgttaaattacattaattgattatgttagtaattgtattagtttgctcagggtgccattgtaactacccaacatattgtccctgcccactgcctagactttatcaagacaggggaattgcaataaagagtttaattcacacag

SEQ ID NO: 416841 - DNA, 356 bp, Homo sapiens
catttgatctccagcaaagctgtgtcgaataaaggattccactctagtttgttgagaaaagtaaattggggctgggcgcagcggttcacgcctgtaatcccagcactttgggaggccgaggctggcggaccacatgaggtcaggagttcgagaccagcctgaccaacatggtgaaaccctgtctctactaaaggtacaaaaattagccaggcgtggtggtgtgagtctgtgatcccagctactcgggaggctgaggcaggataattgcttgaacccggaggcagaggttgcagtgagccaggattgcaccactgcactccagcctgggtaacaagagtgagactctgtctcaaaaa

SEQ ID NO: 416842 - DNA, 560 bp, Homo sapiens
ccattctgttattattgaatgaatgttttgtgtatatctctgctgttgcacatatgagtataggtgaggttgtcattgtttgctctgggattcagggagggagtcactttgcataaacctttttttgcatttaatttcttgaatgttcttataaagaagacattatgttggcattcttcatttttatcctgccaacagagtgcttatgagcatgtctgcattttgatcaaaatttaaacagaagagtgaaaatacatttgaaatgaaccctttcagaggaaccctggcaaagctgtatagactggacagagtgagaaaacttccacagccacctgttcacctttctcctcatcttccactgtgttcaatatgtatgttccaagccatagagataattgggattttctcccaggtagcttctttcttctcctgtcactggactaaaatctctgacatgtcaaaaatgccttaaattttaatgaactctccgaaaatgtagttgatattggagaatttattttatttctaattttagatattaaatatattttgtcagcaca

SEQ ID NO: 416843 - DNA, 347 bp, Homo sapiens
gatgaatatacacacagaaataaacctgcaaagctacaagctaaactctaagtctggttatccctgggaggtgggattgtgaggaggacgtattctttgtagttcatgcatttctctattgatggaatgttttacgtaagcaatgcattatattcataattaggaataaaatgtaaagctatttcccatttttttaaaaaagtaatgataataatgatgcacttaatttgtccattcttcagctaaaacaccaaacaatatggaataaattcaagaaactagcttattttaaaatatatccagaaacatattttatatattaaaacgagattaaatggaatatacct

SEQ ID NO: 416844 - DNA, 366 bp, Homo sapiens
ggcaacagagtgagaccctggctaaaaagaaaaaagaaaaaaagcagattctcattcagttggtctgggaggggattctttgtctgatggtcttggtgatatgacactgaggttgctggagattgagcagtagttaaaaagtcttcctaagggttaaaatggaaatgcactggtttttttttgtttttttgtttttgtttttttttgagatggagtcttgctctgtcacccaggctggagtgcagtggtgtgatctcggctcactgcagcctccgcctctagggtttaagcaatcctcccaagtagctgggattatagccacccaccaccaagcctggctaatttttgtactttttttttattggc

SEQ ID NO: 416845 - DNA, 410 bp, Homo sapiens
tgaacataatttgttttttgagacgaagtcttgcttcgtcgcccagggtggagtgtagtgttgtgatcacagctcgctgtggcctcaacctcctgggttcaagtgatcctcccacctcagcctctcaagtagcttgaattacagttgtatgccaccatgcctagccattttttaatttaaaaattttttggtagcaatggggtctgaatatgtggcctaggctgatctcaaactcctgggctcaagcatccctcctgcctcagcctcccaaagtgcttgggattacgggtatgaggcaccatgcccagcctgaacttgatttttttgttgtttccttttcataacaaacatcaaatgccttcagtgtactagttcttctaggttctggaataaaaatgagcaagaggttt

SEQ ID NO: 416846 - DNA, 293 bp, Homo sapiens
cctctctagccatgacctctctccagctccactgaggattgtgctggaacctcaaactcaaacatgtttaaagcaaaactgatactcttcccaatcaaatatccaatcatgcacttgacttgtctatttgtcatcatcaccaaacatgctcattgtcattattcaaatttgaaatctttatcaccttagcttagctcgtcacccactaggtccacctcccatccatcctgccatccatttaccctacaaatagcttcgcataggattgggccttcacaaccattttcccatct

SEQ ID NO: 416847 - DNA, 377 bp, Homo sapiens
ggaccacggaggtcctgttccctgctgtcacgcagagcctcatgcagcacctggcatgtgggaagtgctcaacgaatatttgttgaattagaaataaacagcctgggagcactttgggaggctgaggtgggtggttcacctgaggtcaagagtttgagaccagcctggccaacatggtgaaaccccatctccactaaaaatatgaaaaaattagccaggcctggtggcgggagcctgtagtcccagctactacagctactagggaggctgaggcaggagaatcgctcgaacccgggaggcagaggttgcagtgagctgagatggtgccactgcattccagcctgggcaacagagtgagactgcgtctcaaaaaatta

SEQ ID NO: 416848 - DNA, 120 bp, Homo sapiens
aatatcacaaataagtagcaagggtcctcactatcacaatctcataacccacctttcatgtagagaccacgagaaaacaagtttgaaaggtgtttagccaaagtcaaaggcatttcgatc

SEQ ID NO: 416849 - DNA, 917 bp, Homo sapiens
ggctgcagtgagccatgatcacgccactgcactccagcctgggcaacagagcaagaccgcctcaaaaaaaaaaaaaaaaaggctgggacagtggctcatgcctgcaatcccagcactggaaggccgaggcaggtggatcacctgaggtcgggagtttgaggccaggctggcaacggtaaaactccatctctactaaaaatacaaaaattagtcacgcatggtggcgcacgctaatcccagctactggggaggctgaggtgggagaattgcttgaacccaggaggtggagggcagtgagctgagattgtgccactgcactacagcctggacaacaagcaagactctgtcaaaaaaaaaaaaaaaaaagagaagagaagagagccctgtgcaaggtgggaaaaaaatgaaaactataactaagaatttaatatctcacctttctttttttcttaacaacaacaaaaagatttttagaagtaattgaatgaatttcaaaggttttggtagacatggccatctgctcctcagttcaggctgcaggtgtaacttcagctatatcccttcctgccgctgaaaatggtgtatgttcaggtgtgggaagatcaggcagctggctttggcagagcaagaggcttcagagcaaaagctagcatatttagatgtatattattatatcatgtcactcatagtgagtttctgtaaatccttgtaataacctaataaccaaatccattttctaagcattatccaaaatgctttctcatactgtcccactgagcctttgcaacagctctgagaggtgggctaataatattaaccattttacaaagaaagctgtggaagtgagttgctttcaggtctcacagcgcaggagagagagctggggctccaagttagagccagcttcctttgaattc

SEQ ID NO: 416850 - DNA, 294 bp, Homo sapiens
atatacttaaagtgatataaccatgagtagtggttcttgcaggtaggctttgtacaagagttcagcaataagagcccaaagtgcagatattcaacattcccagcctgaaaactcttagaattgaattttgaattggctaaaccctgtgctgatttgaaagggaaggtttacatggggaataaataatggtaagactgtcaatacattcagagaattgtggacttcaagacttaaaccgtgtggcttggagaggcttcttgaaggatacaggaattaagctaggccttttacaaa

SEQ ID NO: 416851 - DNA, 3617 bp, Homo sapiens
actgcatcatgatgaaactcaatagatgacgtttcctatgtaagtaggtagcccaaaccttcaagctgtgatatgagtaagttctacagatgtttacacaagtgttgccatctttgaaagcatcttctacaagcagaagtctttttcgttgtgtgtctatctttctcattaatgttctttagcctaaatgttaacaactttctaagagtgacctagaattatgttgttggagagaatgatgtgtgttccatggatacctggataggcacataacatgttggaagatgagcacctgctcaggatttgaaatacgtttaattttcaggtgacttaagacagctatgattgaatcaactagagatgatgatcgacttatttaatatgatttcactggtgaagaccaattggtagctttttaaaaagcactttagtgtcctgttttaccttaaaatgttataatattttccagttgtcatgctgtcaacattaacaaaaaaaatcatgttaaggctttgtatcaaacattttgttacactctgtctgaaatgtaatgtggagtacttcagcagtatgtgtcatgtattgtgtgtgtctgtgtgtgtgcatgtgcacacatgtgttttaatgctgggcacagaaaagtgttacaagttccatatcgtaagtccttaaaggggcagaaatatatgtagccaagtagaatttattacattttagtgttattattttaaaacttactgatactctttaacctctcctgcagtaatagttttgctttatttcttactcatttcaatttattgggtttgcaaaattttgtaaactttttgtgtttttagcctttgtattttttacagcctagaatcttgcaaagtctgaatattttttaaatgttctatcttaactagttcactaatacagtatttttagcagacagcattttcagacagcattttcataccaagtttgacttgtggtctccaatcttactgggaaggccctggtagtgtaattcttttccttattaaaaggtaaccaagtgcctctaagtcatgcttatttgtaaacaacaaagaagagtatatgtacctgctcaaaatttttttgataatcgcttatataattaatttctaatgatgaggacatgtaaaagttgccagtaagaacatagtatgcatttaattaaatcaagatggctaatggaattaactttctcccctgttcttgccaggtggaaatgatttaagcatttctccttgcagttgtattgaagtaaattaccataggcatcaagatggctgcatcacattttcaaatgattttatattcagttgctacttataaagcagcattcaaaaagtcttttacactgtcatgttggacacaagcagactcagcttttatcaaaacttgtttaaataaaaaattgacagtagctgggttattaaattatgcaactgaaactcctgaattatatcttttctgtatcccttaataagattggagaccactgccgtttaggataatacaataataaaacgttttaatcagtactaaaactttaattaagccaataatgatgcatgcctgttgtagctgacagcatgggtcagtacatccttcagcgagtgccttactctaattgaaaccaagcacacgtaaggtacaatatgttagactctgtgattttgttttcaaaatcctctgttatggctatatttaaatttattttaaatattcctgtatgtattcatctaagcatttgggcatttggagtcttaatatacaagaaacacgtacttaaatttttatgcttatcaccgcaatgatggcaaacagtgattttttttttcatagtttaggtgtcattgttgccagcacctttagtgctcagtcttcagtgaaaaatataaagtgccaaaaaaatcttgcaagacagaatccatacttaacactctttccaagacactgtgaccatgtacagtagctatttcctgatgaccaaatctctcaacgaatcatgttattaataaatatttttagcactcatcagtattctccaatgtgaccttctcattggagtacacagaaggaaagcaaagaagagcatctgacttctagctctggcttacagcctctctaccaggccgaagcaagagacccgcggcagcagctccccgccactcagacctgggtggtgataacctcaaagaatggctctgttttctattgacagaaaacccacttgattttgcttctgagttagcagtcagaagaccctctaagtacaatagaagtgctcttaacggactctgcctgtgtgactcccaggccccggagtctccatctctctcgtaagccacctgccacagcacagctggaggctgttctctggtgttctcagcgctccggctccctccctggagttgtgcacccgtcccaaactcctccatgcaagttctgcttcctcttataagtacacaactcagttaagtattcacatacacacagaaaatacgggtgtgaaaagaaagaattttctgtaaaaattaagttgaatactttggtaaaaagtgataaaggctgagttgccaataaaagttgcttttaaattaggtgtggctgggaatattataagatattggggaaaatatacaaatcaagaaaatttctgagcttagattgcttcatagatttatttaagtactcatcccacctttaaaacctctaaactgagaagaagggacccaaatcatgttattggtgtgatttatgtgagaagtagaactgtagtcattggacccttaggcaaaggaaaatccgtgtctttatatcagaagatcggcaaacgaatgtatattacacagtttaggttatgattccctactttaacctacttactttattaaatgaccaactactgatactgatcacaatagttattagagattctaatttagttggaaggttctaatcactttcattacaggcatttgaaaaatagggattcatttcgaatatattagccaggagcatagttagatgttacccaggccatttatcatcctgttaatgatgattttcccgacccttgtgagatcagcgtgacaggagtgtgtgtgtgtgtgtgtgtttctgtgggtgtgtggttttggttgggtgctgccaggtggcaaaggcatatgtaaatacatctgatctgcatctttatttcacagttaactaaaagtaaaaatgtctattctgattccatattgattttgtctaagatgtaaaaatttgagttcatctttggccaaaacctacctgaattaacatacaaaatatttgatttttaaaatttaattcaaatctcaaaatcaattaagtattctcagatcctatatcttggttaatatgctcccagatactttaaacatggcaaccttttggcctaagagaatgtttgttcatggaaaaaagcttttgagatgagagggtgtcttactttcttgtggcaattgattttctgttttaacaccctttgggtaaaatcttgcaaagagcttttataatttgttttactgaattgtatggagattgtataccaagtaaagctcttttaaattacaaaaaat

SEQ ID NO: 416852 - DNA, 1710 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttggggccatccagatcctgaatgcagcaatgattctggctttgggtgtctttctgggttccttgcaatacccataccacttccaaaagcacttctttttcttcaccttctacacaggctacccgatttggggtgctgtgtttttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416853 - DNA, 1401 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416854 - DNA, 1572 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416855 - DNA, 1637 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggtctattcaacgtgaagaggatgaggatgaagacctttatgataatctacttccacttaatgaatattctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416856 - DNA, 1598 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttggggctacccgatttggggtgctgtgtttttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416857 - DNA, 1515 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttgggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416858 - DNA, 1603 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttggggccatccagatcctgaatgcagcaatgattctggctttgggtgtctttctgggttccttgcaatacccataccacttccaaaagcacttctttttcttcaccttctacacaggctacccgatttggggtgctgtgtttttctgtagttcaggaaccttgtctgttgtagcagggataaaacccacaagaacatggatacagaacagttttggaatgaacattgccagtgctacaattgcactagtggggaggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416859 - DNA, 1072 bp, Homo sapiens
ggatgttgccactgggtttgatataaggcatcatatcccctagggggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416860 - DNA, 387 bp, Homo sapiens
caccaaggcctactacaatgacccgatgatgtctactactccaaggcaagacagaattgaatattgtacaaactctgttactctgccctggtgtcccatttgtggagagtcattgtaatgtatggacagaattgaacccttctgtaacactcaaaattttagtagctagtggaaaaagggaaagcatgaaggctttggatttcttttctatcacagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttggg

SEQ ID NO: 416861 - DNA, 528 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagccataaacaaccccaatggcctcccacgaagttgataatgcagagctggggtcagcctctgcccatggtaccccaggcagtgaggcgggaccagaagagctgaatacttctgtctaccagcccatagatggatcaccagattatcagaaagcaaaattacaagttcttggggccatccagatcctgaatgcagcaatgattctggctttgggtgtctttctgggttccttgcaatacccataccacttccaaaagcacttctttttcttcaccttctacacaggctacccgatttggggtgctgtgtttgtgagtattcgtactcccctggctatatgttatttcttagataccactgctggagatgtgtttg

SEQ ID NO: 416862 - DNA, 1343 bp, Homo sapiens
caaacatcatatgttctcacttataagcgggagctaagctatgaggatgcaaaggcataagaatgacacaatggactttggggactcagggggaaagttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416863 - DNA, 1539 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaaggccatccagatcctgaatgcagcaatgattctggctttgggtgtctttctgggttccttgcaatacccataccacttccaaaagcacttctttttcttcaccttctacacaggctacccgatttggggtgctgtgtttttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatggcatggtgtctctactgctgattctcaccttgctggaattatgcgtaaccatctctaccatagccatgtggtgcaatgcaaactgctgtaattcaagagaggaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416864 - DNA, 1299 bp, Homo sapiens
cctctaaagtgttgcataaggcaaagataacgttaagtctgtggaggcttccgttatcgggaaaagatgctgtagtgatcttttctgagtgtctcctacttgcgacaaggtggacttgggaggaaagccgtctgccaaagcctgaagcctccaagttctgtagttcaggaaccttgtctgttgtagcagggataaaacccacaagaacatggatacagaacagttttggaatgaacattgccagtgctacaattgcactagtggggactgcttttctctcactaaatatagcagttaatatccagtcattaaggagttgtcactcttcatcagagtcaccggacctatgcaattacatgggctccatatcaaatgaaatttcctcacctcccaattctgtgtaatcaagaatacctccttaattctgagagcatgaatatttgaccttaaatctccagtgactcagagcttcacccacaaactcaggagaacataagcctgctcgtaaagctcaatccttctatcatggcaccaatcacaagaaccttggacgtttgactgactctatcctttctctcctaactataaatcctatttgtgtgtcgtgggtatggaaggacagatatatttctttaggcattcttggatatctgtaacttctatgatcattactccaaagttgtttccagaaattggttctatttcttcttatccacctactccattgctttatgaggtttaaggaaggaaggcggtataatccctattcaatatattttttctaaaatccaacttctgaccgcccagtaggaagaaaaatgagacattttttccattacagagaaatgcttcttgactttaacatcagcattataaaaagtgtcaaataaaaaattaccatcattatcattaaaataaattttcactgtatttgagatgggagggttaaggctcagggattttatttcagtgaactgctggaactcacacatgccctgatatgtaaatgatgatttatgttggcgagtctgagagcaagcccaaatgtgttcttcaaaggacaatgggaaactgtaaagtagagaactaaagaataaggcctttagaatctgacacatctgggttcaaattctgaaactgtcacttattacctgtatgaacatgggcaaattatctaatctctctgatctatttttcctcatctgtaaaataggtgtaataataacaactactttgtcggttgctctgagggttaaatgaaaataaaaagaaaatgtgaaacagcaccacaggtacttg

SEQ ID NO: 416865 - DNA, 1079 bp, Homo sapiens
gcaaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtaaaaccagatgttttccaccaaagccctccttttggctggtctgatttctaccgcactggcagggccatgggctaatatatgtgctggcaagtcttccaatgagatccggacgtgtgaccgccatggctgtggacagtactctgctcaaagaagtcagaggcctcaccagggtgtggacgtcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacatatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccaaagatctaagataaataaacaagagaactt

SEQ ID NO: 416866 - DNA, 1001 bp, Homo sapiens
ctgaatcaggaaataaaattctggaaggacgatcttcccataaatacataaagtccagggaaaactacagtgaaaacagaattgtcaggatcaactgtgtgactgataaggcaaatggggataggaaatgtctgaggccaggagctctgctctcacttttctcctttttagcactggcagggccatgggctaatatatgtgctggcaagtcttccaatgagatccggacgtgtgaccgccatggctgtggacagtactctgctcaaagaagtcagaggcctcaccagggtgtggacgtcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacatatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccaaagatctaagataaataaacaagagaactt

SEQ ID NO: 416867 - DNA, 831 bp, Homo sapiens
ctgaatcaggaaataaaattctggaaggacgatcttcccataaatacataaagtccagggaaaactacagtgaaaacagaattgtcaggatcaactgtgtgactgataaggcaaatggggataggaaatgtctgaggccaggagctctgctctcacttttctcctttttagcactggcagggccatgggctaatatatgtgctggcaagtcttccaatgagatccggacgtgtgaccgccatggctgtggacagtactctgctcaaagaagtcagaggcctcaccagggtgtggacgtcttgtgctctgctggatctactgtgtacgcaccattcactggaatgattgtgggccaggagaaaccttatcaaaacaagaatgctatcaataatggtgttcgaatatctggaagagctttaaaaaatgtaacccatcatcagatgaaacatgaggacagctactcatctttgggagtcttagagtgtcactattattggccacaagaatcttcaatgaaggatcatccactggtgtatcttcaattttgattgatgataatgattttgagttgataaaaacaaacatccctttagaagataaacaggccagcaaaaatacttgctagaagagtgccatgactcagtttataagagagaggctgctattcctctatcctcctccataggaaaatttccattagccagctttaccaactaccataatttaatgcctatcatatatcaggtactattctgactctgggtttataatggtaaacaaaatagaatctctgccttcaatgagtttatgtttggtataaggagaagagaa

SEQ ID NO: 416868 - DNA, 1025 bp, Homo sapiens
gcaaatcaaatagctatccatggaatattagaacttgacttgctccatcctcttaaactttttgtgtctcacactaaagaaatgagagatgcagaattctaaggctaaatagctaggaagtattcattcaaacttgaatattcttcaaagagagtgtgggggcaactctaatcagaggaagaaactaaaggaagtcactggcagggccatgggctaatatatgtgctggcaagtcttccaatgagatccggacgtgtgaccgccatggctgtggacagtactctgctcaaagaagtcagaggcctcaccagggtgtggacgtcttgtgctctgctggatctactgtgtacgcaccattcactggaatgattgtgggccaggagaaaccttatcaaaacaagaatgctatcaataatggtgttcgaatatctggaagaggtttttgtgtcaaaatgttctacattaagccaattaagtataaaggtcctattaagaagggagaaaaacttggaactctattgcccttgcagaaagtttatcctggcatacaatcgcatgtgcacattgaaaactgtgactcgagtgaccctactgcatacctgtaaatcgaaggccaatggtcagatcttcaaaataaaaagtcatcttaaaaacctggatgcatacccttctcttcaagaaatttgtgttcacaaaggaaaaatgcatgaagggatggataccccattttccatgacatgattattacacattgcatgcctgtatcaaaacatctcacgtacctcataaacatatacacctatgtacccacaaaaattttttaattaaaaaaaggaaatttgagtttaaatagaaacatgataaatgcaagaaagaaaacattttgattttaactcattgtcactctgatgttcatgtgaactggttgcttcgggctctttgatctgtcacctatggaatctgagtggttttattttttagatttctcagtcccaaagatctaagataaataaacaagagaactt

SEQ ID NO: 416869 - DNA, 2390 bp, Homo sapiens
ctaagcagcaagccacgcacctcccgcgctggcgaaatccgagacccgccccttccggaagttttgacactttgtgcgccccgggcaatgcgattgagagggtaatcatccggtccgttatctaaacccgtcactccgggaaacagcgacccgatctttccggatccgcgctctcccagcatcctttgccttccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttctttccttagtttggaaacgtagaattctgttttttgtggttaccttagtctctgtgtttttagtttggaaattcacttatgctcataaatacttgctagcagacaatagacattatactttctatgtgtggaaaagagtttttcaaagatatgaaactgtaaaatatttgttagttccagcctatatatttgctggttggagtatagctgactcattgaaatcaaagtcaattttttggaatttaatgtttttcatatgcttgttcactgttatagttcctcagaaactgctggaatttcgttacttcattttaccttatgtcatttataggcttaacatacctctgcctcccacatccagactcatttgtgaactgagctgctatgcagttgttaatttcataacttttttcatctttctgaacaagacttttcagtggccaaatagtcaggacattcaaaggtttatgtggtaatatcagtgatatttcgaactgtgaaaatggacttaataattagaccatttctacaaagaacaactgaataggtggaaaacatggaatttcttttaggtgcagtggtggtcttcaaattacattagttttttttatatatattttaaacatatgtaagaaattaagtggcaaagaactgagaaagcttaagacctgcttcaaaagcctgaaaaatggaaaaataaaattgttttcagatatctcatatcactctcataatgttggccccttaaaaagcttgggaatgttttgtatgtacaagtttattaaaactgggtatgcttcatattactggaatgaatttattctcttcagagagaaatattaggttggtgcaaaagtaattgtggtttttgccattgaaagtaatggcaaaaccacaattacttttttaccaacctaataacaatgtattagcaaatatttacaaatggtcaggtgatattcttgattgaaaagttgcttaacatttcagtaatataattttaattctaagtcaaaatacaaatgcatagatagtaaatgataaagtagagactcatatatgcctgtctagacatcaaatatgggatggttacaataaagatgaagtttcttatctaatgtagtt

SEQ ID NO: 416870 - DNA, 3127 bp, Homo sapiens
ctaagcagcaagccacgcacctcccgcgctggcgaaatccgagacccgccccttccggaagttttgacactttgtgcgccccgggcaatgcgattgagagggtaatcatccggtccgttatctaaacccgtcactccgggaaacagcgacccgatctttccggatccgcgctctcccagcatcctttgccttccggtatgtggccccgtctggctagtcccgcctagcgcgcccatttcgagcccaagtttccagctcgggtttccaggctcagaattttccaggagtaggttcttgggcagtggctgtgggagctggaatggcgcagctggaaggttactatttctcggccgccttgagctgtacctttttagtatcctgcctcctcttctccgccttcagccgggcgttgcgagagccctacatggacgagatcttccacctgcctcaggcgcagcgctactgtgagggccatttctccctttcccagtgggatcccatgattactacattacctggcttgtacctggtgtcaattggagtgatcaaacctgccatttggatctttggatggtctgaacatgttgtctgctccattgggatgctcagatttgttaatcttctcttcagtgttggcaacttctatttactatatttgcttttctgcaaggtacaacccagaaacaaggctgcctcaagtatccagagagtcttgtcaacattaacactagcagtatttccaacactttatttttttaacttcctttattatacagaagcaggatctatgttttttactctttttgcgtatttgatgtgtctttatggaaatcataaaacttcagccttccttggattttgtggcttcatgtttcggcaaacaaatatcatctgggctgtcttctgtgcaggaaatgtcattgcacaaaagttaacggaggcttggaaaactgagctacaaaagaaggaagacagacttccacctattaaaggaccatttgcagaattcagaaaaattcttcagtttcttttggcttattccatgtcctttaaaaacttgagtatgcttttgcttctgacttggccctacatccttctgggatttctgttttgtgcttttgtagtagttaatggtggaattgttattggcgatcggagtagtcatgaagcctgtcttcattttcctcaactattctactttttttcatttactctctttttttcctttcctcatctcctgtctcctagcaaaattaagacttttctttccttagtttggaaacgtagaattctgttttttgtggttaccttagtctctgtgtttttagtttggaaattcacttatgctcataaatacttgctagcagacaatagacattatactttctatgtgtggaaaagagtttttcaaagatatgaaactgtaaaatatttgttagttccagcctatatatttgctggttggagtatagctgactcattgaaatcaaagtcaattttttggaatttaatgtttttcatatgcttgttcactgttatagttcctcagaaactgctggaatttcgttacttcattttaccttatgtcatttataggcttaacatacctctgcctcccacatccagactcatttgtgaactgagctgctatgcagttgttaatttcataacttttttcatctttctgaacaagacttttcagtggccaaatagtcaggacattcaaaggtttatgtggtaatatcagtgatatttcgaactgtgaaaatggacttaataattagaccatttctacaaagaacaactgaataggtggaaaacatggaatttcttttaggtgcagtggtggtcttcaaattacattagttttttttatatatattttaaacatatgtaagaaattaagtggcaaagaactgagaaagcttaagacctgcttcaaaagcctgaaaaatggaaaaataaaattgttttcagatatctcatatcactctcataatgttggccccttaaaaagcttgggaatgttttgtatgtacaagtttattaaaactgggtatgcttcatattactggaatgaatttattctcttcagagagaaatattaggttggtgcaaaagtaattgtggtttttgccattgaaagtaatggcaaaaccacaattacttttttaccaacctaataacaatgtattagcaaatatttacaaatggtcaggtgatattcttgattgaaaagttgcttaacatttcagtaatataattttaattctaagtcaaaatacaaatgcatagatagtaaatgataaagtagagactcatatatgcctgtctagacatcaaattgttggttattgtttacaatctagaaatgatgaagctctttcactaattcctaatatgaaatgtatgatggccaaagacaaattgtattgattataatcctttaaaagggggatttcctttctgaaatacatattgtattagcttcccagggcttccataacaaatgacgacaaacttgggtgcttacaacaattttcctcacagtctggaggccagaagtctaaaatcaaagtgtcagcagagttggttccttctggaggctctaaggaagaatccataaacagacattctatgtctgtttcctaatatcttgtggctgtgtgcaattcttggagttctttggcttctggacaaatcttgtccaagtattgcagacagcaatcttcactccagtctctgcctctgtgttcacacggcctttccctctgtcttctcttcattaccttttaaggacagtgtctttgaatgtagggcccaccctgatctagggtgattgtgtctggagacccttaattatgtttacaaagacccatgttccaagtaagtttgtattcacatgatctgagtagacattgtctcttcgtgggatacttttcagtccatgacagttactaaaggacattttaggatagtcttcatatgattgttaggagactacctttttagattttttttattatatatcaaattatagttgtatatacttatgagaaacaaagtggcattatgatttttgaatataatgtgggattaaataaagctaatctatccatcacctcaa

SEQ ID NO: 416871 - DNA, 175 bp, Homo sapiens
gcggccgcctactactactactgctcgaattcaagcttctaacgatgtacggggacatgatggcagagacatccagtcaggacctgacccgtctctgtctgaggccggctcagcagtgcagcctggtccctgggggctggacccaggctcctaaataaaccagcaactccctcga

SEQ ID NO: 416872 - DNA, 1874 bp, Homo sapiens
gctcctgccgggcgccgagcccgccgcgcactgctactgcggccaccaattcggccagttcgccgggcagctgggcgacggcgccgccatgtacctgggcgaggtgtgcacggcgaacggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 416873 - DNA, 1980 bp, Homo sapiens
gctcctgccgggcgccgagcccgccgcgcactgctactgcggccaccaattcggccagttcgccgggcagctgggcgacggcgccgccatgtacctgggcgaggtgtgcacggcgaacggcgagcgctgggagctgcagctcaagggcgccgggcccacgcccttctccagaaagaagatgctgatatgctacaacacggatgaacctggaggacgtggtgcagtgaaataagctggtcacagagagacaaatcctgggtgatcccacttacatgagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 416874 - DNA, 1605 bp, Homo sapiens
caaaaaaaaaaaaaaaatagccacaacaacgtcttttcctttttcttattttcacaaggggctggggtcaggtttggcctgttgacgcctcgggtcttccctccaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 416875 - DNA, 1726 bp, Homo sapiens
gtggggactgctgtctggttggggggggccaggccagcagggtggtggtggcaccaggatggacagtggcctggccctggggcaggtgtggcccctcagtgaactgacccttctctgcttctttggggtctctactgggcctgagtctggggttccctgatttttctagtttgggtaaaagccaaattttgtgagcatattaaagagtggatgctgtgagtgcaacgcactcttcatcgccaccttgtggttgaggcggtgacaggacatcaggaagatcgcccagaaactgcagagtgagagccactcagcgaagcacagccggtttcagggaggggaaggatggacacgagtggggaggtctgggcaggaccccgaggagggagcaagcacactgtcccaccccaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 416876 - DNA, 1556 bp, Homo sapiens
gctcctgccgggcgccgagcccgccgcgcactgctactgcggccaccaattcggccagttcgccgggcagctgggcgacggcgccgccatgtacctgggcgaggtgtgcacggcgaacggcgagcgctgggagctgcagctcaagggcgccgggcccacgcccttctccagaaagaagatgctgatatgctacaacacggatgaacctggaggacgtggtgcagtgaaataagctggtcacagagagacaaatcctgggtgatcccacttacatgagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtaatgccgggggcctttcggcctgtctacacgcacttgcttagagtcctaggagatttgggcctgtgctgctaggattctggtagaaacaaacccagatgaccgccttggcctcttctgaaagtccagcctgtccctggcagcctcagaagctgcctgtccgcgaagtagctgcgtcacgcccactgggagggatctgagtgcaaaggcatttggtactcagttaggacacttgtgctgagccctcccacgtgcccggccaggccctcgttgcagccagagatggccctgcgggagctggtgtgtctcaaagcaccagcagggggctccagggccacgggcaccagagaagggtccctgcctggtgcttctgggggggagggggtccctgagcctgaggctggggacagtgtccagagctgtttgctggagtttatgacaaggaactacttagacttgactgaggaaatggccactgaagaagcaggagccgcaagctgtgcgcggtgtcctgctcaggctttctgatctgatggtccagttgctcgttggtctggagtcctaggctggctcctgtctgacgtgagccatcagttatcagttctcttttctttttttttgagacagagtatcgctctgtcacccaggctggagtgcagtggcgtgatcttggctcagtgcaacctccgcctcccgggttcaagcgattctcctacctcagtccccccaaatagctggggttacagacgtgcgccaccacgtccagctaatttttatatttttagtacagacagggtttctccatgttggccaggctggtctcgaactcctgacctctggtgattcacccatcttggcctcctaaagtgctagaattataggcctgagccaccgcgcccggcccccagccatcagtttttgatgtcaccttgccacctggcgtctagcacttcctcctgaacacctgaatgtagttgtctgttggtcttgcagccccgtcctgcccgggacaccagccgcccacccctgaggctgcctgtgggcctctggcttttcctgtcctgcagggggatgg

SEQ ID NO: 416877 - DNA, 340 bp, Homo sapiens
cgtaagttaaaaagtgttgcggctgtggagaaattggaacccttctgcactgttggtgggaatgtaaaatgatagagttgctgtggaaaacagtgtggaagttcctcaaataattaaatcaccacatgattcagcagttctgcttctgggtatatccccaagagcaggatctcaagatttgtataccgatattcatggccaaaaggcagaacaagtgtctatcagcaggtgaatggattaaatgtgatgtgtacatacagtggaatattattcatccttaagaaagaagatgctgatatgctacaacacggatgaacctggaggacgtggtgcagtgaaa

SEQ ID NO: 416878 - DNA, 352 bp, Homo sapiens
gaacacaacatggatctatcctcttaaattgtggagggcaccgcacatcacagctgacgcaggagcagtgctgtacagccgagccctggagcttgttcacatccgccacccaaaccctgtgtgagccggttaccagctccccattcccctccctgcagcccctggtagcaaccactccgctccgagtctgtgaacctgactgctctaaacccttcatgtaagtggagttacacagcgtgtgcctgtttcttcagtctgttgtctccctctaatcttcgtgtaagtggagttacgcagcgtgcgcctgtttcttcagtctgttgtctccctctaatcttcgtttaagtggagt

SEQ ID NO: 416879 - DNA, 2028 bp, Homo sapiens
gctcctgccgggcgccgagcccgccgcgcactgctactgcggccaccaattcggccagttcgccgggcagctgggcgacggcgccgccatgtacctgggcgaggtgtgcacggcgaacggcgagcgctgggagctgcagctcaagggcgccgggcccacgcccttctccagaaagaagatgctgatatgctacaacacggatgaacctggaggacgtggtgcagtgaaataagctggtcacagagagacaaatcctgggtgatcccacttacatgagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggggctggggtcaggtttggcctgttgacgcctcgggtcttccctccaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 416880 - DNA, 2091 bp, Homo sapiens
gctcctgccgggcgccgagcccgccgcgcactgctactgcggccaccaattcggccagttcgccgggcagctgggcgacggcgccgccatgtacctgggcgaggtgtgcacggcgaacggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggaacacaacatggatctatcctcttaaattgtggagggcaccgcacatcacagctgacgcaggagcagtgctgtacagccgagccctggagcttgttcacatccgccacccaaaccctgtgtgagccggttaccagctccccattcccctccctgcagcccctggtagcaaccactccgctccgagtctgtgaacctgactgctctaaacccttcatgtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 416881 - DNA, 2186 bp, Homo sapiens
gctcctgccgggcgccgagcccgccgcgcactgctactgcggccaccaattcggccagttcgccgggcagctgggcgacggcgccgccatgtacctgggcgaggtgtgcacggcgaacggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggaacacaacatggatctatcctcttaaattgtggagggcaccgcacatcacagctgacgcaggagcagtgctgtacagccgagccctggagcttgttcacatccgccacccaaaccctgtgtgagccggttaccagctccccattcccctccctgcagcccctggtagcaaccactccgctccgagtctgtgaacctgactgctctaaacccttcatgtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacaggtgagccctgcgtccatggtcaccgggggacggcgggtcgcgtgctggaaaaagtccagcccggctgtgactccagagcccggatgtcattccagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 416882 - DNA, 288 bp, Homo sapiens
tgaactctgtgtttggtttcagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtaatgccgggggcctttcggcctgtctacacgcacttgcttagagtcctaggagatttggg

SEQ ID NO: 416883 - DNA, 417 bp, Homo sapiens
tctaattatccaagcgggcgggcggcagaggtgacatgcagcaagatgggctccgagtcatttacctggaatgcagccaagacaaggctggagaaggcagaattccaatgaagctgacactcaggacactgagcacaaagaaggaggcatctatgaactcacaggtcacaaggtcacagatgaccgcctcctgcctgctgacgatggctcgatccacggtggactgttccaggtactcgatgcgcatctgagccacctgcagctgtaagtatgagagaagtctattggacatctgttgtccctgataccaggacagagacatgggattaatatacaggcggccctcatgtcttcacaactattcatcaactcacacctgggagaaagcaaataaatttgcatttgaagctgccaggt

SEQ ID NO: 416884 - DNA, 293 bp, Homo sapiens
ctcaaatctcttaatctgcaccttctggaactctgtcttgttctctaggtcacagatgaccgcctcctgcctgctgacgatggctcgatccacggtggactgttccaggtactcgatgcgcatctgagccacctgcagctgtaagtatgagagaagtctattggacatctgttgtccctgataccaggacagagacatgggattaatatacaggcggccctcatgtcttcacaactattcatcaactcacacctgggagaaagcaaataaatttgcatttgaagctgccaggt

SEQ ID NO: 416885 - DNA, 239 bp, Homo sapiens
ccttgcacagtatgctacggacacaatgatgagcaaacccatccctaccttagaagcctagtctggcagaagacagacgtttcacagccagttacaacagaaggcagtgacgggcatgttattcacagctagcatctcttctggagccccacctttgtgccagccccgggcatacctgactccactgaattcccagaaccttccaaggcccaggttccttagtcatcttcattttccag

SEQ ID NO: 416886 - DNA, 838 bp, Homo sapiens
atgatgccattatagcttcatatactatttattaagttattaatatgaacagatatgcaacattacagatgtctttcaaagcctgtaataaaatatagtccactatccagcccaggagaaagacaacaaacagtatcattcttatagtaagtgtagcatacgtactcacaatagttcccttatttggacatcaaagggaacaatcagtcaagattctttacctccattagaatttaactttcttggattatagctgttttagagtcaaaagtccaacttagattatccacagagatgtgtagcatcacatgttggagaggaaggagctactgtcacctccgtggcagccctttctactgtcttgcagtccttctatatcgaagcccatcttgccttttaggccagtagtggtcaaatttgggtatggggagaaggcaggtgggtcacagggaggttttgattaatttacaaagattgtgtttcaaagctctaaaaacccatttggtggtggcagtggcagtgaagagtacactatatttcgccaagggggtcttctcatctcttgagtcttggctttctcatatcctttaaaattgctgcagttctcagtgggaaagtggaggtggcaaactctaacagcgattggtatggggccatctgcagaatgaactggactggctactatggcttttataacctgctttcctttctttagtctagacaagcttatttcttcatctttccacctacgtcctgctagttctaacataagatttaaaaggactatggaagataaaacttctcactttctagctgaatgatgaaaaacagcaaaaaa

SEQ ID NO: 416887 - DNA, 836 bp, Homo sapiens
gtgctcgactccccttcctctctatttcccactcccataagaccgagagtttgcaacaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416888 - DNA, 851 bp, Homo sapiens
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcaggcggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgtgaacttctaatttcatatcaagagttgtaatcacatttatttcaataaatatgtgagttcctgcaatgg

SEQ ID NO: 416889 - DNA, 1231 bp, Homo sapiens
  misc_feature (25)..(25): n is a, c, g, or t
  misc_feature (69)..(69): n is a, c, g, or t
  misc_feature (71)..(72): n is a, c, g, or t
  misc_feature (1125)..(1125): n is a, c, g, or t
cgtgtaaaactagaataaaaaaaanaaaaaaaagcccgccatcccactcatagtgagtctcattatgangnngattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaatagagaacagcaccgaaacataaacgacgacgttgtttcgccctcctatcgtgaagcgattatcctcttagtcccttcgtatcccacatgaacgccacgcctcccggttggcctgtcacgcttctccgggcgatttccgactccctattcccgcgccgtcattcgttggaattaaccatcacaggcgatcggtctcgatatggatagagaaacgtgacatggcgaagcacgaaataatcgcgggcgtgttccgaccggcgacgtacacaccttcaattttcaccgatacatcaccaccccnatcattccctcacatcatccccccgtctccttcaatgcgcgttcatattcatccccccctcacgtcattcgccatttcttccctccctacactctttatcactagg

SEQ ID NO: 416890 - DNA, 383 bp, Homo sapiens
tcccttcctagctgtaatctcaaattacctctcctgtaaaaccaggctcataatacacagattgtaaaggagaattagatgagaacatgtagaaggtgcctagcacagaacccagcccatggtggaccttctagaattactgattgcccctccccttgtcttattgcctgtcatatcagggctaatatatcagcttgaggtatatatacagtatctagatccttaaggttgttaaaagaatctccctattcccacagactttggtctccatcagaaaaagtgacagacattcaaccagactttcatataactcagtgacaagacaaaaatgaggatccatgacttccatatcttgaagcaaaataccaccaaaaaccgtgagg

SEQ ID NO: 416891 - DNA, 1487 bp, Homo sapiens
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcaggcggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416892 - DNA, 1267 bp, Homo sapiens
aggattaggcactgctagtttcagctcccatcccctctggcatccactgtgtgagacgaaatattcccccctttagttaaatactcatcccctgataagggtttcgatgactcatcgaaacccttcatcaacctggtcatcgaaaccctagggatggtgtatttctggcctttccaaatgaaagcaaactacttctgatgggttttatggacagggtttgatgaccccgcatcggcatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416893 - DNA, 987 bp, Homo sapiens
gtatagctgattctagaggatcacccggaaagcacactgcaacaccccttgggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416894 - DNA, 834 bp, Homo sapiens
ccaacgtagtactaacatacatagaacgagatgcaactatccggatctcatgaacaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416895 - DNA, 832 bp, Homo sapiens
caatgggagccgaggggcttgggactacggcacgaggaagactgaactgttcaaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416896 - DNA, 824 bp, Homo sapiens
  misc_feature (25)..(25): n is a, c, g, or t
  misc_feature (69)..(69): n is a, c, g, or t
  misc_feature (71)..(72): n is a, c, g, or t
cgtgtaaaactagaataaaaaaaanaaaaaaaagcccgccatcccactcatagtgagtctcattatgangnngattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416897 - DNA, 834 bp, Homo sapiens
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcaggcggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggactttggtctccatcagaaaaagtgacagacattcaaccagactttcatataactcagtgacaagacaaaaatgaggatccatgacttccatatcttgaagcaaaataccaccaaaaaccgtgagg

SEQ ID NO: 416898 - DNA, 422 bp, Homo sapiens
caagagtaaagtggccactactctaaaggtttgagccaagcagtgctcaatggatgtcaatgatatttctttggaaatatgcccaatgtcattttataaagtcacaatcagaagacaagagtttaaatgatagcaaagagagaaggactgttgtattcagctgtgagcacaacccacaataaaccaaaacccactacatctattgatgccagagcctgcctgccttgtacaatgaactcttctcaatcttgtgtgtgcttgtgtgcactggggtgagtgggaggtgataaagtatcctgtttaactccacagtctttacttcaggaaggtgagggacgtttggggaaatgttctgctcgagtgtttttcaagaatcagaaacccagaccaaccatcaatgtaacttgtacacggctcatcga

SEQ ID NO: 416899 - DNA, 223 bp, Homo sapiens
  misc_feature (206)..(206): n is a, c, g, or t
gactgggaagcagagaccaccatcacattgactgtagacctaaaccagaagataatcatggacatattgatccctctctgagactcatctgggatttggctttccttggaagctcttacgtgatgtgggaaatgacaacacaggtgtcacactactacttggcacagctcactagtgtgaggcagtggaatctccctattcccatnatgactttgggcgagaa

SEQ ID NO: 416900 - DNA, 1507 bp, Homo sapiens
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcaggcggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaaataatgaaatgtgttgaatg

SEQ ID NO: 416901 - DNA, 1138 bp, Homo sapiens
  misc_feature (19)..(19): n is a, c, g, or t
  misc_feature (51)..(52): n is a, c, g, or t
gaggatccccatcgaggcnatgtgaagacagccagccgacattcttccaannggaagatgtgcatagaaacagatacaaacaaatcacatatatggctcaaggtcttgctgtgagagagatgactggtatgactaagtttaaaccctatttcatttctgcaacttctgagattttgtctcaaaaatgcattaatacaaatgtgctttttttgtctctctcagataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaa

SEQ ID NO: 416902 - DNA, 1894 bp, Homo sapiens
  misc_feature (1788)..(1788): n is a, c, g, or t
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcaggcggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaatagagaacagcaccgaaacataaacgacgacgttgtttcgccctcctatcgtgaagcgattatcctcttagtcccttcgtatcccacatgaacgccacgcctcccggttggcctgtcacgcttctccgggcgatttccgactccctattcccgcgccgtcattcgttggaattaaccatcacaggcgatcggtctcgatatggatagagaaacgtgacatggcgaagcacgaaataatcgcgggcgtgttccgaccggcgacgtacacaccttcaattttcaccgatacatcaccaccccnatcattccctcacatcatccccccgtctccttcaatgcgcgttcatattcatccccccctcacgtcattcgccatttcttccctccctacactctttatcactagg

SEQ ID NO: 416903 - DNA, 793 bp, Homo sapiens
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcaggcggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctggtatgaatcagcatttggaatttctatattcaggaatgtatgtaataactaaatccttaaaagaaagatcatttaagtttttatccctaaagtggcactttcattcaactaaatattgtggtatccctcataatttaaacaaaactcagaggtatcatctttctgttcttcatctctaatccaacacagtaactccaccaacagcatgtatccctttcatca

SEQ ID NO: 416904 - DNA, 686 bp, Homo sapiens
tcttttagtttactaacttgacttaagaagtcctgatcattttttgatgttcatgcataccgtatagatcctacctcatttgactcctacaaaatatttgttaagggtgttctaaaagttactttttgtagttaaactacactttatttacatttgtttgttatggaaataatgcataataatcgttaaaaatccaaacaaaaggggggaacatattaaaagaaaagtaagggtctccctgctactctacctacctacccacctaccttatctgttaccatatcctagacccaactgcaattaacaatttctggttttagttcttctggttcttttcattataaccttaaatactgtacatatacatcttgactcaccagctgaaaatccttcaaagggacaaaaacttattcttaactcctaatttaaaaaattgtattacttttagttttgctagaagctttcatgactttaggttgtttacctaaatcattatttataaattttacacactgtatattggctccctactaggagaggtgaggaattggtacattcttactttctcgtcttttcccctccccctcctaattttgttagtttcattctcatttttagtctgtcaagaatttgcattctttttgtaaataaaattacagacatcccttggtatccatgggggattg

SEQ ID NO: 416905 - DNA, 403 bp, Homo sapiens
ccctctcctgtaagggtatttttttaacgtcattttagacataaacaggctttaaagagtagaagtgcttttgaagataatgagttacagtatttcaaagaaactgtacttttatttttctaatcaactgagacagacaccattctaaaaaggtcaagaatcataaacttgacaagaaaagttttcatcactctaggcctttccctttacattatataagagcaggaatctgggaagaattaagtccctcccattccctctcccaataacttgtaaaaaggagtagcagtcacaaaagaaaatatgattcatagatatattctaccatgtgttttgacttgtagaatttttcataccagaaaaggttaaacattttattaactgtaaggtgtttaggtgggta

SEQ ID NO: 416906 - DNA, 466 bp, Homo sapiens
agaaatctgtctttataaaaaagttcaaatttattgctctaaaattacattttaaaatttctgtatggttagtaactatatcccctcttgcattccatgtaaaatatctattttctttttttgttatgataagcttaattctagcctttttgaaaaattaagtcctgatatgattaatcctctattgtgcgttagatataattaattaaattctgctatttatttccttccatattttttatgggagtttatattgctaattcttttcctaacttcttgagatcaatgctataacagattctgttatgttgttcaatcctcatattccccagaagagaagattatgcatattcaacactgtcacctgccttttaagaatatatattccaaaattagccaggtttggtggtgcatgcctgtagtcccagctactcaggaggctgaagcactgcttgagcccaggagg

SEQ ID NO: 416907 - DNA, 436 bp, Homo sapiens
ttcagagaaaagttctaaaaaactttaaaaataagaaaaggctttgaaatctatgaaaaatgtttcatttgattattcttcccaaatatacaggaactaaatataagattatgtatctttgaacagtataactgagaggaggggagagtaaatgacttacccaagataacagttcaatgtgctgagcactcttctctcctggtatctcttctttagatgtaacaaagctccaaaactacttgggagagttgtatagtaacgtagaagtatagctgactttgctagttgtatgggccgccttttttgaaattttgttggataggttaaaaaaaaaattgctagatgcagtggctcacatctgtaatcccagcactttggaagacccaggcgggagaatctcagaggcaggaattcaagaccagcgcccccataggaa

SEQ ID NO: 416908 - DNA, 390 bp, Homo sapiens
aggccatcagacatagtttggaactacatcaccacctttcctatgtctccacattgcacacagcagattcccagcctccataattgtgtgtatcaactacttaaatacattataacacacacacacacacacacacacacacacacacacacatacaccatttgtcctgtttctctgaagaactctgacaaaatacagattttggtactgaaagagattctagaggaacggaattttaaggataaattttctgaattggttatggggtttctgaaattggctctataatctaattagatataaaattctggtaactttatttacaataataaagatagcactatgtgttcatggcttgaactggtaataaagatacaaaaatatccacat

SEQ ID NO: 416909 - DNA, 387 bp, Homo sapiens
taaaaattatttcaaaatattctcaccaaggaatgagtaagctgaagtatttatctaccgaatctcatatgccattgattgagagttgctcctgttggtgttaaaccttgtgtatgggctgagtgaactcctgagtaccagtgaaaattacaggtagaaaagctaagacatgcgggcacttgaggggacataggacctgtccatcacaggtgtagaagacagtgaagtagaagtaagcatgagactgatatctttaaaaccaaatgaagaaagtgtttcaagaaggaggtatgtattgactgtgttgatggaccaagtaagatgaattgactactgggtttgacaccatggcttctacattttctagatgcaccctagaggttctcc

SEQ ID NO: 416910 - DNA, 345 bp, Homo sapiens
aatacatttggtaaaatttttactaggaaatgttctatcttttctaaagatttcaaattattggtatgaagttcttcataaaaatccttatattaacattttaaatcctcagtattctgcagtgttctatatgctttgattaggtcatgtgactgttcattttgtatgtcaaattgactgggcaaagggatacccaggtagttggtgaaacattattttggggtatgtctgtgagagtatttctggaagagattagcattcgaatcagtagattgaatgaagaagatcccccttcactactgtagataggcgttatccagtccctgtgtgggaagcaaggactgt

SEQ ID NO: 416911 - DNA, 336 bp, Homo sapiens
cctgggtgacagagtgagactctgtctcaaaaataaataaataaaataaaataaataaaaataaaaagtttgtttccaaagtgcccaatggaattttttatgtgtacattatatataactaggcctttctattcatgtctctgtctctcacacacacacacgcgcacgcgcgcacacacacacacactgtcatcctctctctctccctagtttatttagtgaatttcttgatgtagatagcttcaacagttgaagtaaatagggatttgtttttagtagggctaaggaaccttaagatgaaaacaaagatattaaactttacttatggttttcctc

SEQ ID NO: 416912 - DNA, 412 bp, Homo sapiens
gcttgtggctaaggtatggaactgtttggttgtttgatttaatactctttcttgacaatcttgaaagtatcaaccttaagcagtcccccaatttttagaaaaaaatattggtttatgagattaaaatttttttaggaactgctgttgtatactataatgctaagttgtgcattcaatgctctatgtaatgaacagagttaaattgacctaaatagaattgattttctcttgaactggtatagtgactaaacataattctgaataaccatgtagtctgcattatttggttgttaatatggccaaaataaccagactgactctggcaacaagtctgtcttcttagcaaagtaaacggattgactatatgtctatataattgctttctcagcagttgtgtaatgcttgatccagt

SEQ ID NO: 416913 - DNA, 1336 bp, Homo sapiens
  misc_feature (955)..(955): n is a, c, g, or t
gagagtttggacatgtcataggttgtgggtaagagaaaacctaagataatctattcttccttccccgttgtttataccttatgtttgcagtgcctttattatttcttctgttttccctgtcacaattctgatgttacaaaatctagcccaaatctctctcaaagccatcccagactctttcatgccactctgatttctccctcttactctatttttatctgtaactgtatgtaacacatagcttattgtctgagtatagacattcagcaaactttggttgattggaaagtcttcgtttaaacttctaatttctctaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcattgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatntctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatc

SEQ ID NO: 416914 - DNA, 1435 bp, Homo sapiens
  misc_feature (1054)..(1054): n is a, c, g, or t
tcccctgtctactgggatattgaaactctaggaggtgtctttaccacaacttattaataggaataccatcgtattccaaccaagaagagccaggtattctctactgccgcctgatggtcaaacgcaagtggcaagattaaagtgtgtcagggtgaatacgagagatggctggatgacaacaaactccttggacagttcactttgattggaattccaccagcccctcgtggagttcctcagattgaagttacatttgacattgatgccaatgggatagtacatgtttctgctaaagataaaggcacaggacgtgagcagcagattgtaatccagtcttctggtggattaagcaaagatgatattgaaaatatggttaaaaatgcagagaaatatgctgaagaagaccggcgaaagaaggaacgagttgaagcagttaatatggctgaaggaatcattcacgacacagaaaccaagatggaagaattcaaggaccaattacctgctgatgagtgcaacaagctgaaagaagagatttccaaaatgagggagctcctggctagaaaagacagcgaaacaggagaaaatattagacaggcagcatcctctcttcagcaggcatcattgaagctgttcgaaatggcatacaaaaagatggcatctgagcgagaaggctctggaagttctggcactggggaacaaaaggaagatcaaaaggaggaaaaacagtaataatagcagaaattttgaagccagaaggacaacatatgaagcttaggagtgaagagacttcctgagcagaaatgggcgaacttcagtctttttactgtgtttttgcagtattctatatataatttccttaatttgtaaatttagtgaccattagctagtgatcatttaatggacagtgattctaacagtataaagttcacaatattctatgtccctagcctgtcatttttcagctgcatgtaaaaggaggtaggatgaattgatcattataaagatttaactattttatgctgaagtgaccatattttcaaggggtgaaaccatntctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttacccattctggaatttttttttttttaaataaatacagaaagcatcttgatc

SEQ ID NO: 416915 - DNA, 437 bp, Homo sapiens
tagctgaacaggtagcacagctggggaggatgtggaggctccgtgccccttctcacaggccctgcccagtgcagctcttcatctgtgtcctttgtaatatcctttatgataaatgggtaagcacaaggcagatggaattaacagactgtggctgctgtttttaaacagggtttgccaatatctgtgtgtctcttgggaggatgaggccgtctttctgcaacaagggagaacagaatcacaagatctttaggggggaccttgacatttcctgtggcagatttcagtattgctggtcagaactcatttcatccatcagagttgctgtaggctttctttctaagttccttaatcatctttagccttccttggatttaccaggccgtggatgctgaaaataacaatcctggtgtttcaggacaggagtggacttttttttt

SEQ ID NO: 416916 - DNA, 644 bp, Homo sapiens
tagaagttatgcaaacctatgcaaaccccatacaaatgagctggccaggccagtgtctagttgggcaaaaatatcggaaatattgtgcacaccagcctgtcattgctgtcacagaaggagagcaacaaggagaagggttatctctggtgcatttctggattaaatcataactttagaatacttttctcttttacaaagtctgactgtctctctaagtaagacatcttggataaatgtccctttccctctccgtgtttccgcattgcatgttaattttcaggtggcagttttatctcattagtcattgtcacttccactgatcacccctttgaagctacatgtaaactttacttttaaactttctaaaaatgcggctttccccccttgctttaggttccagaaaacgctttgttcctggcactgtccaaccttagggatcacataggagtcaggctcacaggcttctggggccagaggagcactttaataccaggtcagcagtcactcagttgtttctgaagttggaatggcagatttgtctcagtggttctccttttaaacccttttatgccggaggttgcaattttttgaattgcagacgtgtgaaaaatcagaccttggcaatgaccttgagcagtaggata

SEQ ID NO: 416917 - DNA, 320 bp, Homo sapiens
aacaggttgatggtaaaacaaccctgtaataattcaataaaaatgataaaaatttatctttatgagataagcaacaacatccatccctcttaccctttaggtactgctctatttttttcaaacttggccactatcttagggaagcataaatatattttttaaaactccaccaacatagagatttcttgttgagagactatgaacatattcctcgctcataaaaataactaacgattgtatgagaatcaagtttgaattactgaaatagaaataaagcatacctctatacttttcatgttgtaaaagtactttattaccag

SEQ ID NO: 416918 - DNA, 468 bp, Homo sapiens
aatatttttttttctccagaaataaaatctcactcagtcacccaggctggagtgcagtggcacagtcttagctctctgaagcctgaaactcctggcctcaagcaatcctcctgattcagcctcccgagtagctaggactagaggcatgcaccactatgctcagctaatttctttaatgtgtggaggtggggatcttgctatgttgctcaggctggtcttaaactcctggcctcaggtgattcccctgcattggcctcccaaaggactgggattatgggcacaagccatttgagtgaaatttagaatgcttccttccctttacatcactttattcttctccatttataattgtcttaaatatttatttgtatttgagaaccatatcagtttttttgttcttcaaccatcaaacataatttagaaaacccaaaaggaaaaggagaatattatattgactcattttgcatt

SEQ ID NO: 416919 - DNA, 609 bp, Homo sapiens
tcagatcatctccatgacccttcacccactctgtgaagtgggcagcttataggtgttgtcatctccctagagatgaggaaggtcagaataccaggaagtggccaagacaggactaggatcccggggttttaaagtcatcacagcgctgcttgggctgcagccttcgggcccctattgaatgttcttcattcttacctcacatgctccttcgcgcttcatgggagatgccccttcccatttttcttccaacaccagcctttgagcctcttggctcctgcctctcccctgtccccttaggatctttgtcttccagcacacttttgggaggtgctgctttacttaagaacctccgggctgttctgtacctggactataatgttcacattccctagactgtcctgcagctgccttgctctggataaattcactgcttctcacccccactcccaaaacctgcttacatgcacacacatgcacacacacacatacacaccttgccagttgccacctgaggggctgtgaatatgacctcctttttcttccctgccattctaaaaccattatcatcttcaaactccagatgaaaactagccttcttcaaaaaaaaaa

SEQ ID NO: 416920 - DNA, 786 bp, Homo sapiens
tattgtcggtctagcagtaattgttgtataactctatgttccccaaagttgggtgcatctacatttacgatagttaagtcttcttgttgaattgaaccctttatcgttacgcaatacctttctttgttttattttactattaatgatttaaagctattttttcttaaaagagaaacaattccaggtatggtagcttgtgccagcactttcagactgaagcagtcggattgcctgagaccaggagtttgagaccagccgaggcaacacagcaacatactgtttgtacaaatttttttaaagaaactatacaggaggggtaatgtgcacaactgtggtcatatttactcaggagacataggtggcatgactgcttgacttccgaaatttgaggttacagtgagctgtgattccaccagtgtactctgtcccaggagataaagtaagatcctctgcataaaatgaaaaaaaaaaaacacaacgataacaactttgttgggccggctcttgggccctgagaaaaaggctttgtaaacaccaattccgttgtgggccgcggggcccccaagatggtgttacgtggacaaccgtggcccatgagtggttccctagaggacaccctgggctatgacaatagtcgcggggaatctctcccgaaaattaaaaaacggccgggggggaaacccggagggttctctgaacaacacccaaaaggggcttcgtagaggacaaacagggggactcttacacaggggctccaggcaacccgatataaatatgccggcgtgg

SEQ ID NO: 416921 - DNA, 527 bp, Homo sapiens
acaggccccctatgtgctgagaaatgaagttctccacattagcagaggagagagggcaaccatcaccacccagatgcttgacatccgagatgatgacaacccacaggatgtggtcattgaaataatcgatcctccacttcatggccaattgcttcagacacttcagtccccggcaacccctatctatcaattccagctggatgaactctctagaggccttctccactatgctcatgatggttcagacagcacatccgatgttgcagtcttgcaggccaatgatggacactccttccataatatactgttccaagtgaagaccgtgcctcaggtaggtgtcattcctagagttacagtttctttgcacctagatgtgaacttctacggttgatattattttatgatactcacaaagttaagatatgggtagtcattcacttattcaaatataacctattatatagagggcactatatatctagttaggagcacccttgatctgaaagacctgtccccatgttctctac

SEQ ID NO: 416922 - DNA, 549 bp, Homo sapiens
cagtgtgtccagggttggaaacccagctggcagacagtagcagtgtaggagggtcccagacctgctcgtggctttcatggtatgactccaagccaggcatcttaactagcaggacaggcgtgttgctcatagtccacatcagccaacagatgtgtgaaccacgcccacaggctacgcagatggcaggtgtgatacgatcacatgtatattggttttcatccgcaattcctggctcataactcccatagcccttattacaatgttttgttatcatgttgggtgagttaggcctcaggagcaggccccaggaaacagagtctctctctttgaccttctcctgtcctcctgtcacctgcctaaggcaggactctaatctgattgtgggtcaagagaccgattccagaggggtcttataggaaggcatgccacacagagaggccaagaaaagtctgaggctgggcacagtggctcacgcctgtaatcccagcacttagggaggccaaggcgggcagatcacgaggtcagaagttcgagaccaccctggccaat

SEQ ID NO: 416923 - DNA, 390 bp, Homo sapiens
ttttttgagatggaatttcactcttcctgcccagtctgaagtgcaatggtgtgatctcagctcatggcaacctctgcctcctgggttcaagcgattctcctgcctcagcctcccaagtagctggaattacaggctgcataaggggagtgaacacaaagtacatttgaccacaaaatgactctttaaaagtcagaactacggtagcatgaagccaaacgaggtaatctacaataaaattttctatgcttcttttccttctttgctctctttctactctaataactgcgattcacacaggtaatgaagagtgtaattccttgatagaaacacagctccaagattaatcctttctttaactatgaagttcgcgtgtccaaaatctgtggtagt

SEQ ID NO: 416924 - DNA, 766 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccgggggaagccgggccggcttggggcttggttctatgtccctgcgggtcggtgcaagggcgaagaggaacccgtgggcctcaggggatcccggggggccggaccagtgttccctagttgtgggagcagacgcgtgggcacattgcgggcggctatgtttccagtgtcctctgggtgtttccaagagcaacaagaaacgaataaatctctggttccacagaagtctccagtcttcaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagaggcagagactcactcccgtttgtattatgaaaacacacgccaataggacataaaaagaagcaagagtactgggctttaccatgagttcaaatctcatttctggcaattcctatgtctaaaaaaagcttcgtaatctcttttgagccctcacattctctatcttagagaatcaccttgaccagaatgttcaacgccaagaaaaatactagaaaggttttttattctttccagattccttaaaaattctgaaatttttagacccctggattctgcataaaaa

SEQ ID NO: 416925 - DNA, 873 bp, Homo sapiens
  misc_feature (7)..(7): n is a, c, g, or t
  misc_feature (9)..(9): n is a, c, g, or t
  misc_feature (11)..(11): n is a, c, g, or t
ccaattngncnttggccgggggaagccgggccggcttggggcttggttctatgtccctgcgggtcggtgcaagggcgaagaggaacccgtgggcctcaggggatcccggggggccggaccagtgttccctagttgtgggagcagacgcgtgggcacattgcgggcgggcagggcctgaagtgcagctatgtttccagtgtcctctgggtgtttccaagagcaacaagaaacgaataaatctctggctgcataaggggagtgaacacaaagtacatttgaccacaaaatgactctttaaaagtcagaactacggtagcatgaagccaaacgagggttccacagaagtctccagtcttcaaatcttcagtgtatgaaagcacagattcctgaaagaatggcctcaaatgaccaggagtaggagctctctatatccctgctcctgaaaaacaagctaactggagtctccatcacctgccaccagctatacacactaccaactacccaactgaactccatgactgatttgccagctaatcatgcccctgacccagcccacatggacatgggaaggacatcagtgaactgtgaaaagaggcagagactcactcccgtttgtattatgaaaacacacgccaataggacataaaaagaagcaagagtactgggctttaccatgagttcaaatctcatttctggcaattcctatgtctaaaaaaagcttcgtaatctcttttgagccctcacattctctatcttagagaatcaccttgaccagaatgttcaacgccaagaaaaatactagaaaggttttttattctttccagattccttaaaaattctgaaatttttagacccctggattctgcataaaaa

SEQ ID NO: 416926 - DNA, 390 bp, Homo sapiens
cactgtcttgattactgtggctttgtagtaaggtttgaaagtgaaatgtgtgagtcctccaactttgttctttttcaagattgttttgactcttctggatctctcattttcatatgaagtttaggatgtttgtcattttctgcaaaataggcagctgcaattttgataggggtcgtattaaatctgtagatgagtttggggagtattgcctttacaataatattaaatcttaacaatccaagggcatgggaagacgttccatttttttaaagccctaatttcctttagtgttttgtttgtttgttttgagacaaactctcgctatatggcccaggctggagagcagtggcatgatcttggctcactgtaaagtccgcctccctggttcaa

SEQ ID NO: 416927 - DNA, 2202 bp, Homo sapiens
cagcaccacaccaggaccctccagaggctgtgagaaacatcctgcacccaggtcctctctatctgtttatcattgtctattttgtattctgcattcagaaccaagagcctgaagacgacccaggagctttagctatggctgtcttcattattttgtccctgtttagtgttctggtgacaggcatgggtgaaggtggggctgggagtgagaaaggaggtgagagggaatgtaagctgaaccagcttccccattgcccctccgtatctcccagtgcccagccttggacacaccctggccagagccagctgtttgcagacctgagccgagaggagctgacggctgtgatgcgctttctgacccagcagctggggccagggctggtggatgcagcccaggcccagccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccatgttgttccaagagtacctggacatagaccagatgatcttcgacagagagctgccccaggcttctgggcttctccatcactgttgcttctacaagcgccggggacggaacctggtgacaatgaccacggctccccgtggtctgcaatcaggggaccgggccacctagtttggcctctactacaacatctcgggcgctgggttcttcctgcaccacgtgggcttggagctgctagtgaaccacaaggcccttgaccctgcccgctggactatccagaaggtgttctatcaaggccgctactatgacagcctggcccagctggaggcccagtttgaggccggcctggtgaatgtggtgctgatcccagacaatggcacaggtgggtcctggtccctgaagtcccctgtgcccccgggtccagctccccctctgcagttccatccccaaggcccccgcttcagtgtccagggaagtcgagtggcctcctcactgtggactttctcctttggcctcggagcattcagtggcccaaggatctttgacgttcccttccaaggggagagggtggcctatgaagtcagtgtccaggcggccttggccatctatggaggcaattctccttctgctctacgaagccggtacatagatagtggctttggcttgggccacttctccacgcccctgacccatggggtggactgcccctacctggccacctacgtggactggcacttcctttttgagtcccaggccgccaagacaatacgcgatgccttttgtatatttgaacagaaccagggcctccccctgcggcgacaccactcagatctctactcccactactttgggggccttgcggaaacggtgctggtcatcagatctgtgtctactatgctcaactatgactatgtgtgggatatggtcttccaccctaatggggccatagaaatcagactccacaccaccggctacatcagctcagcattcccctttggtgctgcccagaggtatggaaacaaagtttcagagcacaccctgggcacggtccacacccacagcgcccacttcaaggtggacctggatgtagcaggtaaggcatcctggcagaggcaaaagtgctggaggggtgagctgaagtctccatgcctagctttaaaagttttcgttgggctgggagcagtagcttatgcctgtaagcccaacactttgggagactgaggggggtggatcacttgaggtcaggagttcaaaaccagcctggccaacatggcgaaatcctgtctgtactaaaaatacaaaaattagctgggcatgggtatgctgtaatcctagctactcgggaggctgaggcaggagaatcacttgaatctgggagtcagaggttgcagtgagctgagattgagccactgcactccatcctgcgtgactgaacaagactttgtctcaaaaaaaaaaagtattccatgctttaaaaattacctctgtgattatagaatttattatattgtatactatgtataaatatgatatattgatataagtatttagatttctatattca

SEQ ID NO: 416928 - DNA, 2125 bp, Homo sapiens
cagcaccacaccaggaccctccagaggctgtgagaaacatcctgcacccaggtcctctctatctgtttatcattgtctattttgtattctgcattcagaaccaagagcctgaagacgacccaggagctttagctatggctgtcttcattattttgtccctgtttagtgttctggtgacaggcatgggtgaaggtggggctgggagtgagaaaggaggtgagagggaatgtaagctgaaccagcttccccattgcccctccgtatctcccagtgcccagccttggacacaccctggccagagccagctgtttgcagacctgagccgagaggagctgacggctgtgatgcgctttctgacccagcagctggggccagggctggtggatgcagcccaggcccagccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccatgttgttccaagagtacctggacatagaccagatgatcttcgacagagagctgccccaggcttctgggcttctccatcactgttgcttctacaagcgccggggacggaacctggtgacaatgaccacggctccccgtggtctgcaatcaggggaccgggccacctagtttggcctctactacaacatctcgggcgctgggttcttcctgcaccacgtgggcttggagctgctagtgaaccacaaggcccttgaccctgcccgctggactatccagaaggtgttctatcaaggccgctactatgacagcctggcccagctggaggcccagtttgaggccggcctggtgaatgtggtgctgatcccagacaatggcacaggtgggtcctggtccctgaagtcccctgtgcccccgggtccagctccccctctgcagttccatccccaaggcccccgcttcagtgtccagggaagtcgagtggcctcctcactgtggactttctcctttggcctcggagcattcagtggcccaaggatctttgacgttcccttccaaggggagagggtggcctatgaagtcagtgtccaggcggccttggccatctatggaggcaattctccttctgctctacgaagccggtacatagatagtggctttggcttgggccacttctccacgcccctgacccatggggtggactgcccctacctggccacctacgtggactggcacttcctttttgagtcccaggccgccaagacaatacgcgatgccttttgtatatttgaacagaaccagggcctccccctgcggcgacaccactcagatctctactcccactactttgggggccttgcggaaacggtgctggtcatcagatctgtgtctactatgctcaactatgactatgtgtgggatatggtcttccaccctaatggggccatagaaatcagactccacaccaccggctacatcagctcagcattcccctttggtgctgcccagaggtatggaaacaaagtttcagagcacaccctgggcacggtccacacccacagcgcccacttcaaggtggacctggatgtagcaggacttggtggcctgggtgacagctggttttctgcatatcccacatgcagaggacattcctaacacagtgactgtggggaacagcgtgggcttcttcctccgaccctacaacttctttgacgaagacccctccttctactctgccgactccatctacttccgaggggaccaggatgctggggcctgcgaggtcaaccccctagcttgcctgccccaggctgctgcctgtgcccccgacctccctgccttctcccacgggggcttctctcacaactaggcggtcctgggatggggcatgtggccaagggctccagggccagggtgtgagggatggggagcagctgggcactgggccggcagcctggttccctcttccctgtgccaggactctcttc

SEQ ID NO: 416929 - DNA, 1789 bp, Homo sapiens
cagcaccacaccaggaccctccagaggctgtgagaaacatcctgcacccaggtcctctctatctgtttatcattgtctattttgtattctgcattcagaaccaagagcctgaagacgacccaggagctttagctatggctgtcttcattattttgtccctgtttagtgttctggtgacaggcatgggtgaaggtggggctgggagtgagaaaggaggtgagagggaatgtaagctgaaccagcttccccattgcccctccgtatctcccagtgcccagccttggacacaccctggccagagccagctgtttgcagacctgagccgagaggagctgacggctgtgatgcgctttctgacccagcagctggggccagggctggtggatgcagcccaggcccagccctcggacaactgtgtcttctcagtggagttgcagctgcctcccaaggctgcagccctggctcacttggacagggggagccccccacctgcccgggaggcactggccatcgtcttctttggcaggcaaccccagcccaacgtgagtgagctggtggtggggccactgcctcacccctcctacatgcgggacgtgactgtggagcgtcatggaggccccctgccctatcaccgacgccccatgttgttccaagagtacctggacatagaccagatgatcttcgacagagagctgccccaggcttctgggcttctccatcactgttgcttctacaagcgccggggacggaacctggtgacaatgaccacggctccccgtggtctgcaatcaggggaccgggccacctagtttggcctctactacaacatctcgggcgctgggttcttcctgcaccacgtgggcttggagctgctagtgaaccacaaggcccttgaccctgcccgctggactatccagaaggtgttctatcaaggccgctactatgacagcctggcccagctggaggcccagtttgaggccggcctggtgaatgtggtgctgatcccagacaatggcacagaaccagggcctccccctgcggcgacaccactcagatctctactcccactactttgggggccttgcggaaacggtgctggtcatcagatctgtgtctactatgctcaactatgactatgtgtgggatatggtcttccaccctaatggggccatagaaatcagactccacaccaccggctacatcagctcagcattcccctttggtgctgcccagaggtatggaaacaaagtttcagagcacaccctgggcacggtccacacccacagcgcccacttcaaggtggacctggatgtagcaggtaaggcatcctggcagaggcaaaagtgctggaggggtgagctgaagtctccatgcctagctttaaaagttttcgttgggctgggagcagtagcttatgcctgtaagcccaacactttgggagactgaggggggtggatcacttgaggtcaggagttcaaaaccagcctggccaacatggcgaaatcctgtctgtactaaaaatacaaaaattagctgggcatgggtatgctgtaatcctagctactcgggaggctgaggcaggagaatcacttgaatctgggagtcagaggttgcagtgagctgagattgagccactgcactccatcctgcgtgactgaacaagactttgtctcaaaaaaaaaaagtattccatgctttaaaaattacctctgtgattatagaatttattatattgtatactatgtataaatatgatatattgatataagtatttagatttctatattca

SEQ ID NO: 416930 - DNA, 417 bp, Homo sapiens
agagcactggtcaatataccgtgaccacaccatgaacttttatattatagctacactatatacatcactcctaatcttccttcatttaagaatgtacttcatctttcagcccttgacaattgagatgattgtttgtcatcaaagcccaattcagatgctgccttttctgtcatgcttgtccatttctctttgagttaatttattttactatttgcatttctgcaacactttatatttcaattgaagcaattaatttgctttttgccctatctctaagtctgttggaaatgattttgtttacccccacaagttgcaagccccttgggaatatggctcaggtcctattcctttgagtttttcttagtttagtggacgaaatgcattttgttggattgaactggattgaaaatttttcag

SEQ ID NO: 416931 - DNA, 479 bp, Homo sapiens
ttggagttctctctgcctaagtggtccccacccctaaaaaataactaactgctcagtagcctcataaataaaactaatttttctcgtccttctgtcttaacacacacgctcatgcatttccaagttatttctggtgacctaaaagacgcacgcatgccaaacgcctgcagattctgccagagtcaaccttcttctcctgtcttagtggccagagaacagtccctggaattcaaaggataaacaaggcctgcgtccagacagagttgtttctctgaaacattgctggcttcttctgagtttgattcagctgttctctgatgaaattcagggaaaacttgccttcagagatatctctcaaattttactaatcttcagctttagttggtcaacattcattccacaaatatcaattgaactcctactgtgggcctggtggtggtctgagtgctgaagatacagtgatttaaaaatattaaaaa

SEQ ID NO: 416932 - DNA, 378 bp, Homo sapiens
caatagaaaggttgctgtgataaacctgagagacaccagaaggaattttaacatattgaccatactaaacaatatttaacatattgattgtattcagctatcttttacaatgtggtgtacagactctaaaatagctcctaattgtccctgtcctattttttttttaatactcatgtccgtgtataatccccccttgtctgtggatggaaactgtgacttaacggtaacaaatagaatttggcaaatgtgatatgttaagattataatgtctgctatgctaggagattctctcccttgctggtttcaatgaagtaagtggtcatgttggggaggcccatttggcaaagaactaagggtgacttcaggccaatgactaac

SEQ ID NO: 416933 - DNA, 436 bp, Homo sapiens
tggcttactgctgtccttgtgatagtgagttctctcaagatttggttgtttaacaatgtgtgacatcttgcccctcactctctcgcttgctcccacccttgccatgtaatgttcctgttcccactttgccttctgccatgagtaaagctccttgaggccttcccaggagcctagcagatgccagtgccatgctttctatatagccttcagaaccatgagcaaattaaactgcttttctttataaattacctagtctcaagtattgctttatagcattgttcttgaagttaggctgcaagaacagcctaacacataaaattggtcgtgagagtgggacattggtataaagatacctgaaaatgtggaagcaactttggaacttggtaacagaggcttaacaagttcagaggactcagaagaaggcaggaagatgagg

SEQ ID NO: 416934 - DNA, 1429 bp, Homo sapiens
agcattaggtatatctcctaatgctatccttcccctctccccccaaaacaccccccaaaacatgttcttactgtataagaaattatgaatgacatttattttatgttaaaacagtatattttatctacaaaaggagtaaaagacagtaatacaaaaaattggcacataaaggaacaaaaatgctaaaaaattaaaatttaccaataatcctatcacctaaattgataatttttaatataattaaatgtaggattttaaaataattaaatgtaggattttaaaataaatttcttttaatttatttatttaaacatatagattatttttagaccctcttcaggcatcccctgttgaataagttccatgatttacaggcctactctctctattattaaatattttattgctttcaatgaacaacattttttgtaaacattttcacagaaacaaatatgggcacattgagacatgttttcttttcaaaaagtcctagcactttaattactgtgtaaagagatattagtgtacaattttcacacatattgactaacgtccctgcaaaatgttgaatcaatttatacttgcagcaccaatcggcaaattaatgtccattatgctttcgcttcaccaaaactgatacttatattttattttgctagacaaaaatacatattatcttaatttgcataactgtaattaatagaaagattaaattttttttcagatgtatcataggacatcattttttcttgagtctggtgggtgcttagttcctttaaagcattaatcttgtatacattaattttatgtgcaaaacaatcattaagtacaatttgaaatatggacaaataaatagctggattaagaaaaaaacaaatagagcttctggaattaaaacattcactaatggaatttcaaaacacagttggaatctttaacaataaactagaccaagcagaagaaataattttagactttgaaactggtctttcaaagtaacccagtcagacaaaaataaaagaaaaaagaactgaaaaacaaagcccttaagaaatatgggattatgtaaagtgaccaaacttataacttattggcattcctacaacagaagaataaaaagtaaccaactaagaaagtatatttaagggaataatttaggaaaagttctctagtcttgctagaaaggttgacattcagatataagaaattcagagaacacctgtgggatagtaaacaagatgcccattcctaaggcatccacagtcattagaatagctgtggtcaatgcaaaagaaaatatattaaaggcagctcaaacaaagggccaaattacctataaagtaaattagattaacaacagacttagcagcagataccctgcaacctagaaaagattggggcctagcgttagccttctcaaaaaaaaaaa

SEQ ID NO: 416935 - DNA, 2400 bp, Homo sapiens
ggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaaaaaaagtcgacg

SEQ ID NO: 416936 - DNA, 2006 bp, Homo sapiens
ggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaaaaaaaaaaaaaatttttggggggcctgggccctggaaaaagttttctaaaccattctgttggggcgggcggcgggcgcccacggtgggtacgtgtagaactggtcgtccatacgctggttcccaagggagaatccgggcgccaaggaataggtcgtggggtttcctccccatataaaaaacggcccgggggcacccggagtgtctctgaaaaatccaaaggggaggtcggaaggcatagggggtcgataacgggagtcaagggagcgaattaatac

SEQ ID NO: 416937 - DNA, 2259 bp, Homo sapiens
ggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaaaaaaagtcgacg

SEQ ID NO: 416938 - DNA, 1030 bp, Homo sapiens
ggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgaggtgaggcggggccgggcaggcagcatggacccaggggagaggggtcctgggtcccacgagcctccttcatccgcaaccttgctccccctttacccttttagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttggtgagtagagatggtagctgttacagaactcaagtactcttattcaagaagggtatgtcttcaatctgagtgcttgagagaataaattctcagcacgttttgaatcccagaaaga

SEQ ID NO: 416939 - DNA, 1316 bp, Homo sapiens
ggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaaggtttgtggggcggtttccaattctgccacgggcgatgaagtcaaggattaggcagattgtccggcagcttctctcccacagagtccctgacagtgtgcttggaggagtttcagcacatggagatgtgtagaggtcttgcagcttgagcatggtcagggctatgggataggaatgctatgtggctgcgtagggttagttttctccagcgaagtagaagagcctagggagacccagctagagatcagaaagcaaataagtggcagcaatgaagacaccggggtccagaaaaagagctgttaacctggccatggaggatgatccttgtagagttgagaaaataactttttctatttttttctttttctttcttgctctgttttttcttttcatttctctttctctttcttcctgacacagtttcactctgtcgcccaggctagagtgcagtggtgcgatctcactgcagcctccactttccagtttccagtgattcttgtgcctcagtagctgggattacaggcatgtgccaccacacctggctgatttttttgtgtgtttttagtagagacagtgtttcactgtgttggccaggctggtctcgaactcctggcctcaagtgatccacctgccttggcctcccaaa

SEQ ID NO: 416940 - DNA, 1451 bp, Homo sapiens
ggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaatggcacgtggatcgatccacgtcccattgtgtataaattcagaataccctttttacacaaagaactacaaaaagttacaaagacagccttcagaaccacacttagaaaagtgaccgacagccttcaccaaacctccttcaaagaatctcacaaagcacgtggagagatcctctagatg

SEQ ID NO: 416941 - DNA, 2422 bp, Homo sapiens
ggcctcggggaagcggtcccggaacagcgacgccaggagcccttcatcctccacctcgccgagagccgctgctgtggccgtggctaccgatgggatagtcgccgcggtcgccatcttcccagcaacaacgtcacttcccttccggaccacaaggggcgctgactccgaacttaggacaggaagaaacaggcacatttccggtctctatgctttctcatccggccggcttgctttcccctgcggtcgtccagactattgggcgctagcgagacgaactattggtacggggctagagaggaaggctttgggattgccggggagcagcgagcgaccgacttccgtttccagttaccaaggcacgaggatccggtgttccaacccagggggaaaaatgcggcctttgactgaagaggagacccgtgtcatgtttgagaagatagcgaaatacattggggagaatcttcaactgctggtggaccggcccgatggcacctactgtttccgtctgcacaacgaccgggtgtactatgtgagtgagaagattatgaagctggccgccaatatttccggggacaagctggtgtcgctggggacctgctttggaaaattcactaaaacccacaagtttcggttgcacgtcacagctctggattaccttgcaccttatgccaagtataaagtttggataaagcctggtgcagagcagtccttcctgtatgggaaccatgtgttgaaatctggtctgggtcgaatcactgaaaatacttctcagtaccagggcgtggtggtgtactccatggcagacatccctttgtgtctcttcttttgaatcccagggttttggggtggcagccaaatctacacaagactgcagaaaagtagaccccatggcgattgtggtatttcatcaagcagacattggggaatatgtgcggcatgaagagacgttgacttaaaacgaagccattccaaggacagacggctgtatggaaaggccgagctttgtttcctgtgtttgtgtggactccaccatcatgttgaattttgtcaacactctggcctcttcagggacttcttatttactgtactctctatcactgacaaatgcaggctggattcttattatatacagagatggctcaaaaatggggtttcagatctttgtgacgaaatagaatactgtttcatatttgaatcagagggcttcttgttctgagaaataggttcaaaatcattggaaccaggaacaagaatagcttattgttatctgtgataacactgttttctaaacacaaggattttcttttttattaatatgcaacatagacattgccataacagaataataaaccacatgtggggttttaaaaatgaaatttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaaaaaaagtcgacg

SEQ ID NO: 416942 - DNA, 141 bp, Homo sapiens
gtttacagctcatttcatattctgcaaaatgttttcccgtctgctatcaccgccgccatcctcacagcagcctgggagaaaggcagagccaaaagtctcatctccacttcgtgcatgggtgatctgaggcccagttaagaa

SEQ ID NO: 416943 - DNA, 178 bp, Homo sapiens
ttttttttactgaagtgggattgttatttaaatgttctttgggtaatcctgttccctggacaaccctgacttggacagtgtcccctagggcagaccctccaattcaggttggatctcttgccaggcagatgtgtgagttctctgtggcagtagctcaggcaggctgagggaggggtgg

SEQ ID NO: 416944 - DNA, 778 bp, Homo sapiens
attataaacagcttaactcatttaatgcatcctgctcacatagaggttggttttatatctcaaatccttcctgccagacaaagattaaggtttcagagggcttaatactggactattggtttaatactgaatggttggttgcagtttgtccatagaagacctaaataagcagaactgactaatatttaaagaatgaaatttgtaggcaggtttcaatctgagtttagtataattatgtgtaagaggatggccactcaaagtatttagcacatcctctaaatataaatagatctgtatcttaaatagcccggctcccacctctttaagcccatcatcgtttagcaagcttaaaaatggccactaatgtatggcccttatagttgttttagactttacatagctcagatgataattgctaagtattgtcatggctgattttttttcttaaaagagaggaatttggattataacattttaagcacagaagctctgggttgtgccattcaagaaaaggtttcatgggtatgtatatcattaaaaaaagtactgtttctatagtaaaaaccaaagaggcacaatgaagttgtaagatttgacttcactcactttaaaattattcttaatctgcaggacatgctcatataatgccccatatatatcttagcagattgtaattgaagagtaagatcttcagttcatattgaaagtggccatttctggtatttataatttgagttatcagtactgttacatttaagggaagattcacctcatgatt

SEQ ID NO: 416945 - DNA, 805 bp, Homo sapiens
ccactgtgctccagcctgggcaacagagcaagaccctgtctgaaaaataaaaaagaaagaaaagaaaaaaaaaaaaacaggcaatctctgccatcagggagttatattccaatgagatcttgatggaaaatttggccctacctttaaggcaactttaccttcccagctaatactctaaatatagagtaagagttccttctaggctagaagaatacttttgcaaatatacttcctatttacctaatattttaatcctaaaattgccaaaaatattaaaatcagggagagctgttttcctgttttcctttttgttcttccagagtggttccttttgtaaccatatatggagattagatgtattagcctcttttatttgagaatgtaactttgtgatcgaaactagaacattcagaaatgtctgattttagcatactatgaatgcagcagcggtcacagattagattcccatgggcctccatggccagtgacttcacttctaatctaagttccccgtcactaagcagttgacctttgactacaaatggcagtgagaaaagaagcaaagacttcttgaaattcatcacccatttcacaagttaagccacaaattctgggggtattcttatatggaatagccataacaagttatattttaatgttgtattaaatattttgacagtaatggttttagatgtgtttctaatttctttcaaaatagaaaatatattttaatttccttgattttaaaacaatatatatatatatctacaaatttttcagtgtatgactatgtgaagttaaaaag

SEQ ID NO: 416946 - DNA, 186 bp, Homo sapiens
aggtgttagtagtaatgagttcaggtgtttctccttagggaaggtcaaatgaaggacttagcgacataatgatcctgaaatttgaaatatatatattatatatataatatatatatgactgaaaacaagggtcatatatatacttatttaaaataattattaatatttattattaatttattatat

SEQ ID NO: 416947 - DNA, 370 bp, Homo sapiens
gaactataaagtcttaaaattgctattagtgaattaacaaatcaatccatagacagggtagaaatgaatagagaaagagatgaacaatcctggatcgatgatgactgctggtggcgtatgagtcatatgcgatgaatacgtgtctagaactctgaggtccatcacagaagaaatctagctcattttctgtgtttgatataatcctttagacaggcatcaggaatattagatgagtttggttttagtctttgtatttacatgttttaattctatttttgtaattggccaatataaaaaccaataaacaaatgtataaataaagatgagtaaggttaatcattgtccagttgtaaaaaatatttggtgaggt

SEQ ID NO: 416948 - DNA, 748 bp, Homo sapiens
atggattggacatcttggtaattgaccatccaggaggtacttgagggagagatgaagataaaaaggagatagattgtgttttgtttgtctctccactcagatgtaaactctgtggggggaggggcttgtctattttatttgctgttgcagccccagtgccttcaatactttgaatgaggatatatggacgcatacaaaatatggtgggactttacatgtttcaagactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaaaaaaaaatat

SEQ ID NO: 416949 - DNA, 2746 bp, Homo sapiens
gttcgccgacccaagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggaaatgtggaccctgtacccaggcaggctcagtgtcttgctcctcgctagttggtaaaaggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaaaaaaaaatat

SEQ ID NO: 416950 - DNA, 2272 bp, Homo sapiens
gttcgccgacccaagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaaaaaaaaatat

SEQ ID NO: 416951 - DNA, 465 bp, Homo sapiens
agtgtttgttaaagacacctgctcagtctggggctagctgcaaaaccactaagcatgcatcacgtaatttgttgatgaaaagtttttaagtatcaccagcaaagaatctttgtcataccagctcagttccttccttcaaagaacagattattcttaagtaatttcgataatattatagagcaataagagctctcattgtttagatgcatttgttgaagctatgtcaatggtagttatcctgttgcactgaattacttctttaacaacatacttttttcttgctttgaacagactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattc

SEQ ID NO: 416952 - DNA, 2686 bp, Homo sapiens
gttcgccgacccaagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcgactgtacagtggaagcctggtgcacggactatgccagcaactgctagcatcgacctctgtagaaagtctcctgagcatatgtcctgaggctaagcaactttatgaatatctattcaatgccacaaggtcatatgcccccgctgaaatattcctaccaaaaggtagatcaaattcaaaaaaaaaaaggcagaagaaacagaataccagctgttctaagaacagagggagaaccactgcacacaccaagtgttggtatgagggaaacaaccggtttgggttgttaatggttgaaaacttagaggaacatagtgaggcctccaacattgaataaaactcagtttgcatcaaactagatgtatttaatataatccttacttaaaattcttccgttaccacccttgaaacaattagctttttctttaggactgacctgttaggggataaacatcacaataatctgaattccaagttattttgtattttgtttttaataaatacaacctgatttaagaaaaaaaaatat

SEQ ID NO: 416953 - DNA, 2252 bp, Homo sapiens
gttcgccgacccaagtaggcggagaaagcagaggaggaccggcgggccaagctttcctagcctgacagcagccatttcggaacgtacgtcccagccctctttagctacttagcgcctctgggcccgagaacacctgctccttggctcagtctggcgccaccggcatcacggaactgtacttcccagagacgtcacaccgggagacttccgattcccgctcttgagattggactctcacgtgcaggagccagtcctcgctgggctctagcgggcttctgatggaggagctactcctctgggaggacagaaattagcagcagcctctgtcaccatccaaagattacaacccatgaaaccattgaatttgtgccttgtatcagaaagcaaaggagaatgaaaaagcacagctaacattgcttgaggatctaggcgattaattctttagactgtcatcatgggtatccgaggactaatgagttttgtggaagatcatagtaatgagttcttcactgatttgaagttgcgggacacaaaaattgtcattgatggttatgctcttttccaccgtctttgcttcagttcaaacttggatctccggtatggaggggactatgattcttttgcagatgttgtacaaaaattctttgaatcactgtttgcttgtaatatatgcccatatgttgtattagatggaggatgtgacatttcagataaaaagcttacaactttaaaggatagagctagagagaagatccagatggcccattccctttctgttggtgggagtgggtacgtatgtcccttactcatccgggaagtattcatacaggttttgatcaagctgcgggtgtgttttgtccagtgcttttcagaagcagatcgggacattatgacacttgctaaccattggaattgccctgtgttatcatcagatagtgacttttgcatttttgacctgaaaactgggttttgcccattgaatagctttcagtggagaaatatgaacactattaagggcacacaaaactatatccctgccaaatgcttttcccttgatgcattctgccatcacttcagcaatatgaataaagctctactacctctctttgcggtgctatgtggaaatgaccatgttaatctacccatcatggagacattcttaagtaaagcgcgtcttcctcttggagctaccagttctaaagggaggagacaccaccgaatcctgggacttctgaattggttgtctcattttgccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgagctctccttgaggaggcggcagatgcttctgttagaaaccctgaaggtgaaacagaccattctggagccaatccctacttcactgaagttgcccattgctgtcagttgctactggttgcagcacaccgagaccaaagcaaagctacatcatctacaatccttactgctcacaatgctagtggggcccttgattgccataatcaacagccctggtaaggaagagctgcaggaagatggtgctaagatgttgtatgcagagttccaaagagtgaaggcgcagacacggctgggcacaagactggacttagacacagctcacatcttctgtcagtggcagtcctgtctccagatggggatgtatctcaaccagctgctgtccactcctctcccagagccagacctaactcggtaagcaccatgggaaactttagttcagatggaagcacacaaaagtaaatacagtattttcacttatatttaaagcaacaaagttactt

SEQ ID NO: 416954 - DNA, 345 bp, Homo sapiens
gtgtggactcctatttgtaatctctggcttgctcagatccatgtcccctgtaaagctttcaatatttatcattccagagcaatgaaactctcttctctatagctcccacgcccctaacgctgagttaatttaaaatcatgtcttttctcccaatgaggagatgcaaataccacggggaagcaaattgagacaaaaatccaggttctccagctgcttccactgagctcctttcactctcctgtgtgcctcagattcaaaaggaagcaaatgtgaggcagggagaatttggataaacaggtaaagaaagaaaaccgtttcttccgtgccatcccccacagccactga

SEQ ID NO: 416955 - DNA, 441 bp, Homo sapiens
tcacatttgcaagttcaatttgaacctttttttagtctgcttgtacttctcttatcaagcaagaaagcacttttctgcttttcctattactagtaacagtggagattaaatatctcatgtttttgggcattctagagcccaacacatcacctgttcctttccatactaccacaactgacactctctggaaagtgccacctccctgcagcaggccaaccagtacaaaaatagtacattaaaccagcaaagctaagaaccctcaaagagtacatttcaccctcctaccgcctccactggaacaggtgctggtatccacagctgagagacccacagatggttcacatctcccgactctgtgcagactaccccccagtaccagcctggagcctggtagacttgctgggtggctagatccagaagagagatagcaatcactacagc

SEQ ID NO: 416956 - DNA, 984 bp, Homo sapiens
tggcttgagtttttcaaaacaatcaatcctggtttggggaagtttaaatatggcctgtatatgataccattgaattacttgctcatgtactcaggtgcaagtttggtattgtggttctgcgggagaatgtccttattcttaggagttgcaagctgaagaatttaggggtgaggtgctgctatctgcaactgccatccaaaaggttcagaaaaaatgttctatgtatgtatctctttaaatagagaaaaagaaagaaaggccaaactttaacaactggcaaatcttgctgaagggttcatggatatttattgtgctctttttttcaactttctgtagattagaacatttcccaaataaaaacatgaaaaaacaacttttaatagaatagacatttacatcctctcccattcaaaatttgggaaaaaaatcagtgaaagtggaagagaaatggaagactgaaataatcttaaagaaatgttacagatgtcaggcttaaagaaaaaagagtctgtttgtcacatgtgttgagtacagttctaactgaaggctcatccagtcttagataattacaataatttacttttcttaagtaagtaaactttattatttcagcagctggaattaaaatgggcaacaaatgtagaataagttctcaatcatataaaatagtatctaattgttcagataattaaatgatctaatgtacttaaagcgccagagaacctggcacagaggatatggcctgactacttgcagaggtatgccatagattagacagggcatagacacagctgacactcacaaacacctgttgactgactcactcaactccccatcacctcgaaaccaagctcatatactccacagaagtgattgctaacagttctgggtacagcattttccccacgtgtacaatcggacatatgcaatacatatacatacaatacagctgacccttgaacaacacaggtttgaaccaccttg

SEQ ID NO: 416957 - DNA, 456 bp, Homo sapiens
cagacggagaatgatgatgttcagctgcttcaaaatgacagactctaatcaggattgcccacctatcacaccaaattaccagtaaaaaatgcaaattttctaccgacatgacacttttaaacacagacatctcacagacctccagaagccctgggtatagataagacttgaattactttcctccaatgttacattaggattggaaggcagattttaaaattatgtttttaaaaagcggtcattcttccccatgttaagaatttaaccttaaagatgaaaaagctaagaaactgaagtttgtcagtggattctagcttctgtaaaagttggaagaaaaaaaaaatccacttaaattttgtaaaaattgaaaaaaaaaacaactaaggaataaaaaagaaatgccaagaacatataaatgaaagagcaaaagaacaacttgagtaaaacattatagta

SEQ ID NO: 416958 - DNA, 584 bp, Homo sapiens
ctaattactggattctaagttctcacccccagcactagcccagggcctgcacacagcaggccctcagtaaatggtttttcaaagaataatcaagaggctaacaggtgttatatgacaaacatattcagtaatttgtaaacacagacctttacaaacaatctcaaataggaggtacaaccttcaaacctctcagatgatctctcctttaagaagggttcctggcaagtccaccacagcagttaccccacttcaataggccattcagaaataaacttggtaagatacaaatttttcacaggaaatacaagcagaggaggctaaatatgacctaagagctgactcaacagcctctgtgatggataaggcttctctctctagggccaaacaccccatgttgttctttgtggatataggccagctgtccccagaaactcatcctcctaaactgtaccaataatggccccacaaagccactcagcaacaacatgcaggaagcgtgaaggttaagattgatccggggttgtcctgaaatactgctacaaaatccacgaatgcctacaaccatcactcagcccctttaaaaa

SEQ ID NO: 416959 - DNA, 491 bp, Homo sapiens
gcggccgcctactactactaaaaaaacgacaggtcagacgaaatgaagacttccttagagttgatgggacttaaactgtatattacagaatgaataggccaagtagagaaaatggctcttttgaggttagggaaatattgaatcaaacaaataattgcaggacataatgcaggcatgtattagccctataatgaagctagcatgaccagagcagagctcctgtgggaaataatgtagggaccagattacggctaaattctgctatgtaaagcttgactgaggccttgtggagaatggggagataggatttccatataggatttcattcagagaaatgacattttctgcaaatgctaccctaaagaatgccataggccaggtgtggtggctcacacctgtaattctagcacttgggaggctgaggtgggaggattacttgagcccaggagttcaagactagcctaggcaacatagtgacaccccctctaaaa

SEQ ID NO: 416960 - DNA, 317 bp, Homo sapiens
actggaagacagaataataaaaagtacccaacccgaaaaacagactgggtggggggaaaagtaaaacagagccttagggatctgtaggcttgtaacaaaaaaaaaaaagtaacattcatgtcactggagtcccaaaaggaaaggaaaaagaggacagagttagaaaagtcctccaaaaacactactgtttgaaatgtctcaaatttggcaaaagacataaatctacagatagaaggttagcaaacactaggaaggataaaacccaaagaaacaccaagatacaccaaattcaaatttctgaaaaccaaagacaaaga

SEQ ID NO: 416961 - DNA, 479 bp, Homo sapiens
ccccaggagacatctggcaacgtctggagacattattggttgtcacaaatggaggatgctactggcatctagtgggtagagaccagggatactgctaaataccctacaatgcacaggacagcccctacaacaagaagtattcggcctcaaatatggcaaggttgagaaactgtgagaaatcaattaataatatttttgttgccttcattcaatgagggcagtgtttctcaaaaacgtaaactttctgactccaaactctttactgactccaacaaacacctccaagaattctgaaaaataggcaaatgtttacttagtccccacattttaaaaataagatactcaaggaacatatatgctggtgaatgttagaattcaaatgttaaatccatctaatccttgcaagctttctcatatatgatctcatacatattttctttaccacagccccagaaaggagaactgttaggcccagtgca

SEQ ID NO: 416962 - DNA, 601 bp, Homo sapiens
agataatgctgggtaaagacattattttacaataagtaagtgatttgaagagaataaaatgatatatttggtataatcaacattaatgcaatcataaataatagaaaactctcatgtttggaacacatagtttagattttaaggtaatttgaatatatcatgtgtgattacttagagatcaactattctcagccctggctgtgcattagaattactgaggaacattttaaaaatactgatgtctgggtctcacactcggagattctgatttaatttgggaagtggatcagactctatattctcagagatccatggggaaattctaatgtatagtcaaagctgggaaccaccagtataaaaccttgcaacttagagtgtgggccatagacagtgttagcctcacctacagcttattaaaaatacaaactctcaggccccaccttagactttctgaatcaaagtctgcattttaaggtgaggtaaggtagctgacacctgtaatcccagaactttgggaggctgaggtgggcagattgcttgaggtcaggagttcgagagcagcctggccaacatggtgaaaccccgactctactaaaaaaaa

SEQ ID NO: 416963 - DNA, 310 bp, Homo sapiens
gcaattctgcctcagcctcccgagtagctggaactgcaggcgtgcaccaccacgcctggctaattttttgaatttttagtagagacagggtttcaccatgttggccaggctggtcttgaactcctgacctcaggtgatcctcctgccttggcctcccaaagtgctgggattacaggcatgagccgccactcccggccgctgcagagaatttttaaaataaatgatagattctcacagataagaagtacaggataattatttgccaaagtttgaaactgccattatattcaaaggcattctcttttgggag

SEQ ID NO: 416964 - DNA, 343 bp, Homo sapiens
cagtagagacagggtttcaccatgttggccaggttggtctcgaactcctgacctcaggtgatctgcctgccttggcctcccaaagtgttagtattacaggtgtaagtcaccacacctggccatgtacttgaatattttttaatagcatcctatgaagtcaagaggtcaatatcttttatactttgatatgaagagaagttcatatcaaattaaagactttatacaaatgtctagtgatctttagctgtccactcctatttaagagagaaacactaaaaatctagttgaaagcactgtgcctacaggtggagttgtcaatcattgctttactgtaaggtctggt

SEQ ID NO: 416965 - DNA, 382 bp, Homo sapiens
cttatgtttagaatgtagctttctaggttttactaagtcaggtactacctctccatttgtattcctgcttctaaaatgttattcttagctcctgtctcctgcttctttatgcctttataggtatatgtatgtgtgcgtgtgtgtttaatctctttacttaatgccatgttagtcagagttttggaggcagcggaagcaaatgcatgtgtttagtgtgccatctttctcaaaaagtccaggtgtttttcctacacttagagatcctcaaagaaaatgttttcagaatttttactggcaacataagcattttcataaagtttcagaagagcatcatgtcaaagcttgaagatacttctctgttaaggctctacctcacacaatc

SEQ ID NO: 416966 - DNA, 440 bp, Homo sapiens
agcaacttttaaagggttataaaatatttaacattaaaactataattaacataatttgatattttatcccaaagtcacttcacataagagtaattttctaagcatcaagtatgagaatgccatgacaaaattcaggatgttcgaattatctgctcattttaacctggattaacaagttttcacttaggcctgggatgttttccaaagtaatagatttaaatggtctgttggagattacattgcacacctcctgacaacgactaaaaccggtctctcctcatttccttgtcgcactctgcaaccctttgaagagctggaaaggtggttctcagcctcccctgcatgctttttcaggtcatgctcctggcacgtgtcagtttttcacagctcacgttttcagcactttctgggcactcttggagaaaggaagagcgcccatc

SEQ ID NO: 416967 - DNA, 238 bp, Homo sapiens
ccctgcccatcttctctggaaaccctcctaataaatctttcccacaaatcctcacagaaagcactgcctctggggacctagcctaaggcaaggtagatgcaggattcaaacccaagcctgtgtgtcttcaaagttttttcccactatgttgtggttgagatgttattacaatcgtgttggtctgctctttgttcattttacagttatacatttaaaatgcatcatacaaccctgtctc

SEQ ID NO: 416968 - DNA, 360 bp, Homo sapiens
aatcatcccacttcttataataaagaatctaataatgcagtaaattatgcatcttgtatataaaagatacccccatcccacctccccaacagtcatcttcttaggctcaaggtccactcctctgtgacacggaaggacccttcctctggggaaaggatgggctcagctgcctcagcacgagctgctcctccagcctgcctgcctgtgacactgctacctgctagccagaagcatcccagtgtctactgagctgctgcagattgaacagactgtgaatccagccagaggataagaggttgttttaattggctaaatctgctatgtagtaagcgtatggccatgaatttgtagccaaaacac

SEQ ID NO: 416969 - DNA, 398 bp, Homo sapiens
gtaaatgtttgagttaaattaataagatccccaagatatagggcttaattttatctgcacatgtgagtcttcttgaatgaatggtgtggagtgctgctttttttctgtgcttgtttggcagtttgtttatatggagaagaatgaagaccatgtggtttcagtttgaacggaaattgttgcatagcgatttaccatacagctgtgagactgaacaaatgagtttaaatattatacagtagaaaagaaaactgactttggaacttaaggtattatttcaatttttttctcttctcttctctctagacaaggcctcgctctgtcacccaggctggagtgcagtggtgtgatcatacctcactgcagcctccaactcctgggctcaggcaatccttctgtct

SEQ ID NO: 416970 - DNA, 1112 bp, Homo sapiens
gctggtcttgaactcccaacctcaggtgatctgcccgcctcggactcccaaagtgcttggattacaggccaccacatccggcctcccaaatccttctaaaacaagagtgaagaaacttttaaaaagaaaggagaaacagcaacgaagtttttcagccctgaagcaggtggatagatgtggtgagctgaatctgaaattggtactggggaaaactgagaagaaacccaatttgcacccccacacctgcttggggctcaagagttaatagtaccagagactctagggatccctggaaataggaatgaagtgaggctaaacacagacagctggctgaacatcttttaaagagaccgcttaaagctcccctcagctcccattgcctccctcagtccctactgcaggcatctgcctttccctagccctgatatgtgacaggcttattctctggggagggtgcaaaggaggctctctggacatgggcaccaggcacagttgagggtggggcaccatattgaaaacgggaagaaggagacttgacgtgcagatgttgagacctccagccttcttccctaactcgactcccgaaatgttgccaacacccagaattaaacccactgggcaggatatttgaagaggcttatctggagacttttgggaccagcccaagaggtttctgggtaaaatgacttggccaaagcaccctatgggccaaacagagtcccatagttagcaggcctcacccaaatgcactcagctccctgttctcttgagtgtccccttttaagtctccggggacaaccaagaatgagaagacatttgggaaaactctgtggtgtacagagacaagtaaagaaatcagaaaaaatacatttagaggaacagagaccatgcagagagggaaaaatgtatatatgaatactcacatgtaaaatccttaaatcaaataagtgaatgcattcatgacacaaaagtgtaatgcttgttttttaaaaaaggaatagaaaggaactcttggaaataaaaaatgtaatagtacaaattagagactcaggagcagtgttggaggataagcacacatcccagaaaataaagctaaaagaaaagaaaatagg

SEQ ID NO: 416971 - DNA, 828 bp, Homo sapiens
aatgaaagattgagttgagcagggcagattgaacatgtatttattcccaccttcccaaatccttccttttttttttgagatggagtttcgctcttgttgccaggccggagtgcaatggcgcgatcttggctcactgcaacctccgcctccaggatacaagtgattttcccgcctcggcctccccagtagctgggatttcaggcatgtgccaccacacctggctaattttgtattttagtagagatggggtttatccatgttggtcaggctggtcttgaactcccaacctcaggtgatctgcccgcctcggactcccaaagtgcttggattacaggccaccacatccggcctcccaaatccttctaaaacaagagtgaagaaacttttaaaaagaaaggagaaacagcaacgaagtttttcagccctgaagcaggtggatagatgtggtgagctgaatctgaaattggtactggggaaaactgagaagaaacccaatttgcacccccacacctgcttggggctcaagagttaatagtaccagagactctagggatccctggaaataggaatgaagtgaggctaaacacagacagctggctgaacatcttttaaagagaccgcttaaagctcccctcagctcccattgcctccctcagtccctactgcaggcatctgcctttccctagccctgatatgtgacaggcttattctctggggagggtgcaaaggaggctctctggacatgggcaccaggcacagttgagggtggggcaccatattgaaaacgggaagaaggagacttgacgtgcagatgttgagacctccagc

SEQ ID NO: 416972 - DNA, 437 bp, Homo sapiens
tatgtatttttaggtcaaattaaattgcaagtaagaaacctaaagctgatccctttccccattttctcagagaatttctactgaaccattacccacatcatactatcaacagttatacaggccaggccactacatgaactctatgtatggcagcccacagagaggcttttagtataaggtaaaatatactggtatgagtggaccagcgcaaacccacggtccacgtctacacaatgcgcccctttctcaagttgctcattttgaggctgaggtcactatccctggcactagagactagaagctccaggagttcttccccagatttcagccatttcaccctctccccaagacttgcaggtgagaactccatacttatggccactctccccagtccagtcctctagctttcatctacaccaataacatcccctattacc

SEQ ID NO: 416973 - DNA, 406 bp, Homo sapiens
ctccctgaaaagagtcccgtccagagaaagcccagaaggccaggtgtggcaccaaaggaagcctccagcaattacagaccgagaggaactcacattcaggcaccacataacattcgtgcagactgtgatactaacagaatattgttctttatgagttgctttctttatatttcccaggttaatcccaaaatatactttgctttctaggtacactctagtatcagaaggatcccaaatcagtatgaagaatgcacagtatttacttcagggattcaatcatatgaccacagtagaaataaaagaatggaataatttttggaaaaaaaaagaagcaggaaaagatttctgtgaggtttttaaatagtagattttaacacaattctgcgcaattttaaagttgatgtac

SEQ ID NO: 416974 - DNA, 652 bp, Homo sapiens
aatatatgggctgttttataaaactttggtgtatatctttctaaagaatatatctagcatatcacatgaaattatctgttcttatctaagcctgagggtctgagactttcatgtttgccagtttcatgaaaagaacacaccagctttctctagaacggaaagatttttcttccaaagtaaatagaatagggaaaatgtgattattttatcgtgaaacatcagcttctacatatttctgggggaaaaacagtgtgcaacatttaaagagattctaactcaagttgtctgaatgttttatttagtaaaggagtaatttctgctgaaaatgtgtggatgaataattgtgcttatctgttccctaggttctaagctccaaactcatgccaacagctgatgatgacatggccagaagctgtgccaaatccttctgtgaaaacttcctcaaagctggcggtttgaggttagagtttcaatgtaatgttacatgagttgccgaaaatgaatatagttattttagttaatttcccctgcaaagtcttgcttattcctacaaggtatcatatgactcattgtgagagttattataagaaggaatgatgtttcagtcctttaaaatattttaaatcattttataacttctgattatttgaaa

SEQ ID NO: 416975 - DNA, 2636 bp, Homo sapiens
atcattcccttactcgaatgaattaaagtacaggattggggctaaataatgtgagtgccacgctctttctgaagctcttatatcaaggaacatgcattacaactttcctaatccctgcttccctcacttccagattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgaggtatgtgaactgtgcccgggatgatgaagagcagaacctggtggccttccagtaccacaggcagatcttctatagaacctgccgagtcattaggccaggctgtgaactgctggtctggtatggggatgagtatggccaggaactgggcatcaagtggggcagcaagtggaagaaagagctcatggcagggagagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagaagccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttctttaa

SEQ ID NO: 416976 - DNA, 2267 bp, Homo sapiens
ctagttctaagatcgcgggcggccgctcgcgatctagaaccaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagaagccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttctttaa

SEQ ID NO: 416977 - DNA, 2442 bp, Homo sapiens
atcattcccttactcgaatgaattaaagtacaggattggggctaaataatgtgagtgccacgctctttctgaagctcttatatcaaggaacatgcattacaactttcctaatccctgcttccctcacttccagattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagaagccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttctttaa

SEQ ID NO: 416978 - DNA, 2746 bp, Homo sapiens
ctagttctaagatcgcgggcggccgctcgcgatctagaaccaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgaggtatgtgaactgtgcccgggatgatgaagagcagaacctggtggccttccagtaccacaggcagatcttctatagaacctgccgagtcattaggccaggctgtgaactgctggtctggtatggggatgagtatggccaggaactgggcatcaagtggggcagcaagtggaagaaagagctcatggcagggagagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagaagccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttctttaaaaaaaaaaaaaaaaaaaaaaaaaaaaaattgtttgcggagcgccctgggacccagcagaagaagagtttctataaacatttcgttgggggcggcgggggccccagcaggtgttaggttgcaccggggctccatcggcggttcccagaggaaaaccggggtcaagacatagtgcggggagttccgcaccaattaaaaaaacgccggggggacaaccgacggtttggacaaatccaaaggggttgacgacatacggaataatacaaggagtcaaggaagcgcaatat

SEQ ID NO: 416979 - DNA, 2337 bp, Homo sapiens
atttcaggacttcgctttcgggttcccttgtcctgtgttgtgtaatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggctgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccagatgcctcctgcttggattctgagtggtcagagatctgtaaagcatgactttcaaggatggttcttaggggactgtgtaaagtgttgggtcttcctccaggatgcctgcatgggaccccacccggagctggtgtggccattccccgaagtgccactggcccatggatgggggtgggtgctggtgcacctgggctgggtgtgggttctgtgtccttccaggatctgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 416980 - DNA, 3348 bp, Homo sapiens
atttcaggacttcgctttcgggttcccttgtcctgtgttgtgtaatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggctgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgtaaagtgttgggtcttcctccaggatgcctgcatgggaccccacccggagctggtgtggccattccccgaagtgccactggcccatggatgggggtgggtgctggtgcacctgggctgggtgtgggttctgtgtccttccaggatctgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 416981 - DNA, 1036 bp, Homo sapiens
atttcaggacttcgctttcgggttcccttgtcctgtgttgtgtaatgcccccgttatggcactagaaatattttttattagccgaagctaaatatagtgggactttggctgatcccgagctcggaggacagccggggtgatccgtttccccccgaggatcgaggtggtgcgctctggacggggttgtgcattctcgccgcgcccgggcggacgatccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtggtgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatggcttcgagagggagttgtgactctgcctctttgccagatgacaaaactgagacacacagccgtgacttacttggcaagactgagtgactagtaaataaatgatggagcagagaa

SEQ ID NO: 416982 - DNA, 414 bp, Homo sapiens
gggggtttgttcttggtgggaaaccgtcataaatgtgacttgctagaatatattgatcaatatataaacactgaagcaactacccactctctgcttgcatggcaaagttgtcctcctcaaaagggctgagaaactgatttccacagccagctagtagagtgtggagaacttggcaaatcacgaatgaacaaccttctgtcatcgtttagaaacccctctcctagtacagtcaggctccacaagctacaaataccatccatgagatttggctgccatgcatgatgccacgttgcttgggctggtggcatattttggcttgtgcgatgccatgggcttatctaaaaaaggaaaaagtcactcttattttctccaggataaagctgaattaactgctgcatagtgactctgctgcat

SEQ ID NO: 416983 - DNA, 331 bp, Homo sapiens
agagccacaggcctctgcgtggctttctgcacacggtggtatgactgagatagtgactggttctctatacagaccccggggccctgggtttccttcagaagcagaaggagctgtgggaggtgaatggtgggaggtgaacaggcaggttctgtgggagacacagacacgtgggcagaactccagggagaggccagcaagggagaaccatgtgtggccctgctttttctcaaaccctgtgtggttcccggcttcacagttgatgggaaggtttggccccaaggatattttgacattgtgagtatagagcattttaataaaaattaagtgatga

SEQ ID NO: 416984 - DNA, 568 bp, Homo sapiens
cccggaacatgaccgacgaccaagtgtcttcctatgttgttaaggctggtcttgaactcctcgcgtcaagcaatcctcctgccttcacctcccaaagtgctgggatgacgggcatgagccaccatgcgtggcatatggcacaatctgtatgtatttagagagcccctgaaatcaactctgttcctaatcctctgagccaatgatgactttatagccttatcaaactgaagtaaaacttgaagggcaagttgagtgaactgctgagattttatgagctcatctaggctctcctgaagactgtgtcccaaagtagtacttctgtataactgatatgatatggcttaggaagaagaaattgtttttcttattcaagcttgccttgatgtcctgtgctgaaggtttcctgccatggagcagacagaagtgaccaggagcccagcagggggttcctatgttcctgaccacctcttcagtagccacagaaactacagagctgaacccaagactctggagctcttaatatactctcgtattttactttcacttaccctccataaatgtactggct

SEQ ID NO: 416985 - DNA, 592 bp, Homo sapiens
agaggggaaagatgcctgaaaatcatagactcgggttaatttcaacctgatcatgctctaaagcctagaatgccacagctcggtgaagacagaagtagctcagggtgttacccatccaccctcagagcagtggggggatcctgggtgagacaccactgcctgtactacactccaccctgcacttcctcatccacatatttctcacgttaagttcattctatccagactcagcttctccagaggcatttggtcatgatttctggaaacctttccagatgaactacagccctgactacttcagtgggtcccaaggcctcattccacccactggggacatagcaccatgtagcaactattggtttagatgtatactgcatcctaaagaagagggggcatcctttcagggtgtcatctcccagctggccacagctctatcaagatgacagctccaggatgcttgggtatttatttatttatttatttatttatttattgagacatagtctcgttctgtcgcccagcctggagtgcagtggcgtggtcttggctcactgcaagctctgcctcccgggttcatgccattctcctgcct

SEQ ID NO: 416986 - DNA, 333 bp, Homo sapiens
tttatgaatgctaagaaatgcaaataaccctgtttaaacagatgaggaatacaggaaatgatatacttactaaataaagtattacacagcaatccaaaattataaagatatcacattaacacatcttataactcagatggatactaatatcacaaagaaaaaattgctgtttattcagctatcctacatcaaatattttaagatttaccccaattttcaaagttaaaatgtgcaaaaatatgcatctcagggttgattaaatatggaaatgtatgaaaactggaaaatgctttcacataatagagtggaaaaaacagctgtaactgctataat

SEQ ID NO: 416987 - DNA, 483 bp, Homo sapiens
tgatccacctggctggggctccgaaagtgctggattacaggcatgagccagtacaccaggctgagcagcttttcatatgctagttggccattcatatatttttggagaatgtctattcaagtactttcccactttttaattgggtagtttgaggttttttgtcattgagctgtaggaattctttatatattctggatattaagcccttattagattgtagtagtccattcttgcattgctataaaggaatacctgaggctgggtaatttataatgaagagaggtttaattggctcacggttccacaggctgtacagagagcacggcagcatctgcttctggggaggcctcagagagctttactcatggtggcagacaaagcaggagcaggtgtcttacatggcaggggcaggaccaagagagtggggggaggtgctacacacttttaaacaaccagatctcatggtaactcactcactatcat

SEQ ID NO: 416988 - DNA, 599 bp, Homo sapiens
ccttcctaccagtgcggctcaatgtgctgtgcctgactaagatgtgaccagctcaggcagactgaactaagcacccctcccatcctgcgaccctcactggcctggccttgtgggggctccagaaaagaggctaggagaggccagagtctacctggatccagttatggtgcctcaggggctgcgtcagccaaggaaagggaagtgctgcttagtcctggacttttgggccagggtgagaaactagaggcttctccagtgttgccatatccccctaggttgtcttgatccatgaaccagaaccacagggcggtatcccaggccgtgtgctggccctgccccagcctagctgagtgtgctggcaaagttccccacaggactcagccttctcgtctgtccgatgggagcatccccatcaagtgcagtgtacagtgcagatatgtctccttctttaggaagaataaagtgccttctgagcaagcagctcagggtctgcatcagtgctccaagagtcagtgagcaggtgtgttgaagacttggggcttcagtgttctgctgttgggctgccaaggtcgatggtctctgctctccatctggtgtcc

SEQ ID NO: 416989 - DNA, 248 bp, Homo sapiens
gaagcgcgcagcggcgttctagaggatcccagcggggaacaatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgatggttccccgctatacatggacggcgcccagcgag

SEQ ID NO: 416990 - DNA, 287 bp, Homo sapiens
cgcggggaaccatcacttagttccagtgattgttccagtgattgttccagtgattgttccagtgattgttcagcggggaacaatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgatggttccccgcggggtaccgagctcgcaattcg

SEQ ID NO: 416991 - DNA, 399 bp, Homo sapiens
ttattcaaggacacacagtttaatacaggaagtgcctagtcattctgtgtctggccccagctgggaaaagttctccaattggcacaataactgagccagaaagatccttaaaaaggcagtgtactccaacttcctctgaagcttgtgtcctacctacagaattcccaaccactctgcttgaatgtctccaaagaggaaaaaatttagaagagaagacaaggaaaattaatcacaagataggcaatgaataggcaagtgaatgctgataatgccaagctgtgtttacagtccaaatttttgctgaagaccttcaactttgcactctccctgtgtggtatctcttgcccaagacagaacttcaaataaaatcacatagctgatgcaagaaaccgttaaaaa

SEQ ID NO: 416992 - DNA, 378 bp, Homo sapiens
atacttttgcttctggttctcctctggcagatcaagcaaatacaatccaagtgcgtgcagcccgttcccattcaaaatgtatccgtcataataacagcattctcgctgacgcattagactcaaggtggacttaatttggagatcacctatgaagacatctgtggaaggaatggcctcagcattgcagtcactttcgaagtcaagaggtattctagacagaccacacagcatgtatagaatgctgataatgccaagctgtgtttacagtccaaatttttgctgaagaccttcaactttgcactctccctgtgtggtatctcttgcccaagacagaacttcaaataaaatcacatagctgatgcaagaaaccgttaaaaa

SEQ ID NO: 416993 - DNA, 150 bp, Homo sapiens
gaagcgcgcagcggcgttctagaggatcccagcggggaacaatcacttcactattgtgaagtgatgttcagatttctagttttttttctagtttttaattttaacatcagaactgaaataaaaaattatggatacgtgttttgaattgca

SEQ ID NO: 416994 - DNA, 7298 bp, Homo sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 416995 - DNA, 6359 bp, Homo sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagta

SEQ ID NO: 416996 - DNA, 6752 bp, Homo sapiens
agcgggtacaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 416997 - DNA, 7363 bp, Homo sapiens
cacgaggggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 416998 - DNA, 7427 bp, Homo sapiens
cacgaggggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagacactagcattgcagttggctgaaccttgtgtcaaccatccattccaggagccagctatctgagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 416999 - DNA, 7249 bp, Homo sapiens
ggccgccgccgccgccgccgccgccgccaccaccaccgccgctgccccggctgcctcctccctgaggaggaaacaaagaggcctccgacgggggtgttgacagaacctggtcttctgattccctgtgttctgcttttttcattgttccactggacgctcatcagagggaagatctttttcctcaattgattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 417000 - DNA, 6910 bp, Homo sapiens
accgacgggtcgtcatgaggtcgcaaccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 417001 - DNA, 5983 bp, Homo sapiens
agagcggtgcgggtcgtgctggagaactaagcgcggcagacctcggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 417002 - DNA, 6074 bp, Homo sapiens
ctgaaacctgatgtccatatgtaggccagatgccacattaatcaatttaagaatgctggagcttcgcagaatactgcatgaacaacgagaaccgtggccctgaaagactcaaaaccctacagtatatgaaactattgcaggatgtgtggatgttcaaaggaataacagacttggaagcaatgcttactgaattttgatgtattaaaggatgtcaagtccaagagagagataaggtctcagaagacagaactagaaccatggggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 417003 - DNA, 3638 bp, Homo sapiens
gaagcgcgcagcggcgttctagaggatcccagcggggaacaatcacttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgattctttttttgtgactagaaattcttaagccgatggtcactatagctcatccttaatgtatggctcatttgcttttgtcactaaacggttttgtgttagaaccaccaaaattatagcttttaagagcttcctttgaccactgtctttttcttaccctacttctcttatctttgatcgtatatttctcataatgtgaaatatgatgagattcacttaggggcagcatgttagttttgggaggcaatgtcaactgtgtctctgaattcctgtcttccaaattgaagccagaccatgctgatgacctcaagtagcactgactatttgacaatagggctgataatgtaatcggcttgaattttgacttagtaactttttatgtaatactttcggagaaattctctttaggacaaagcagagagtccaatttattgagggatagattgtatctcttaaagtggtcatattattattaattttgccaaaagaagaagaatttattgaatatttatactataaaatgcagtaacattctacttgcttattacatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 417004 - DNA, 2944 bp, Homo sapiens
tgtaactgaatgtttacacaaggatttaaatgtaataagcaagtagaatgttactgcattttatatttaaatccttgtgtaactgaatgtttacatgtcaagaggaaaagctgtaagaaaatgctgtcacagacccatccctgtggcatcgtcagcagaatactgcttgcttacaatctttattatgcattcttataacataacctcagagtatctttaccaaaggtttttaaagtaaatctctttttaagatagacttattcttttataataatgaatgtgcactcatacatatgtagaaacatttagatttagagttttttttttctttcacaaggtataataaggaaaggatcctacaatattttattctagggtttcttaaatatatgatttatattactgtcttttctattaatcatttgatttaaacaatgccaagtcactcttttttagttgcatgaaattttgcctgcaacagagagaaaaagattgtattactttaatgattataatcatactgtctgctgatataatatcataattgttgtggtttaaatacataaatagtagaaaaatcagagtctataacagaaagtttgtaaaaatatactgattttgaaaagtatcaggaatataaatatttggtaattctgtgtaacaagagagacatggaaaaggaaaaaaatccactatatcatgggctctgcagaacatatcaaaataggatttcttaaatttttcaacccccagaccatactgactcaacatggagtctcactggccaagaaaattgcctttaaaactcgaaaataaggccaggtgtggtgactcacacttgtaatcccagcaatttgggaggctgagacaggaggattgcctgaggccaggagtttgacaccagcctgggcaacatagtgagaccttgtctctacaaaaaataaaataaaataaaaaccaaattagccagacatggtggcatgcgcttgtttaaaaaaacaaataaataaataatcgactcaaaaataagtcatgtgtcccagcataaggcatcaggttgttagatgctggcatctctgcagctcaaagatgtgggttctttttcttgtcattaacacattgttatttctgtaggagcaacttctctgatcaaaattacttttctgggtatgtgctgattaagggggtggacttatcaacactataattgttccctatgaaagattccacagagatgtttatggtgaggtttaaaggatatgaaactctacatttaaacaagtattttatatttgggtacagaggaagaaagagagggctttttccatggggctatagtagagagttagtggaatatagacaggactctgaaaacacaacttccagccatttttttagttagtaaaaatcctattaatgtgaaccagccaggaataacagtgttatttctattggatatggtttgggcttctcttgtcaaatctgtgtcggctgccccctgatccttccattatcaagttttgaagggtgttggggaaattatggcagctgctagggagatcagggaaacactgatgtaacctcaaagcctctcaccattcctcttggcttggaaaggctttattttttcatatacatttctagaaatattgctattctaccttagtatttcacatttgtagttcaaacaagcgattgtccatctgttgcctagagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttcaaagaatctatttacactactatgaatattccactgaagagtcaatgatgtaaatgataaccaccaaatctcaaaaatatactcaccaaaaagtaaaaaagtaaaaaaaaaaaaaaaagaaagaaagaaaagaaagagagagaagtcaacttttcatcttaatatattctagtagtatttattttttccttgtcttggaagtatctcataggtctttaaatgagtaaaacatttttatgccagaaggtgatataatggatgttagtgttttttatttgattttacagtagttttagtcagataatgaggacagagacttcaacttgattctttaccaccattcagcatattttttaattgtcttcattgtatttgcttaatagtggtccagacaagttcaaaacttgttctcagtgaggcattaatatggtgcaaccatgaatatttcaggccaagttattcacttgacagataactagaatgaaacttttctcatgaggctgttgtttggttagcatagccttatttcaaaccttaaaaagttacctgactgaagctactatgacttggtaaggattcttcctctcttgctttcttcctcccttcctttcttcctcttccttcctcctcttcttattttctttcctactttccatcctacctattagtgttgctgtacttggattttttgtaaattaaatcaatgcattatgattttagggaattatgattatattcataaggggaaggctaccagaaaatatatgtggcatccataaaatcttcttttataggggcatattttttaggttgtatttattcgtaaagtgaaatgagataatagagtctttctgtaacatgttaatgaattttcatcagggactgaggtcatagattcttggaaaattcatttgtgactgatctagttttctcagctgtatgcaaagtaatctttcaaagactaggttaagattttttttttaagtctgaagcaatgtaaccccaaatctcaaaaatatactcaccaaaaagta

SEQ ID NO: 417005 - DNA, 3362 bp, Homo sapiens
agcgggtacaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgcaaactattcctcaggaattccaattaaatttattttacttgaataggaatgatcataaaagtgatggttccccgctatacatggacggcgcccagcgag

SEQ ID NO: 417006 - DNA, 1081 bp, Homo sapiens
agcgggtacaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttgaatgctgataatgccaagctgtgtttacagtccaaatttttgctgaagaccttcaactttgcactctccctgtgtggtatctcttgcccaagacagaacttcaaataaaatcacatagctgatgcaagaaaccgttaaaaa

SEQ ID NO: 417007 - DNA, 1117 bp, Homo sapiens
  misc_feature (1117)..(1117): n is a, c, g, or t
cacgaggggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggggaatcccggaggcaagacacttgaggagaggcgctccagcctggacgctgagattgactccttgaccagcatcttggctgaccttgagtgcagctccccctataagcctcggcctccacagaggaaagcagctaaacaggatgttggctggtaacaccagcaaagtggaatcaacctcaaaggagatggtgtcagagtggtgttcaatgcctgagcttctaccgagtgagtcacttgtgtgaaaatgtcttgacacagatagaattgaggtgcccacactatatctgatcacagaaatgttaatgcagaatagcaaactggctttcatcttcatgggattgcaggctgggggataaaagggggtgcatttttaaaggtcatctctattgcttatgagaaaacaatgtatcacatcccatgcatctgtgggactgtgtatcaagaatcagaaataaatcatggcctcgttggcatcagcggtggagctgttcggccagn

SEQ ID NO: 417008 - DNA, 884 bp, Homo sapiens
cacgaggggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaagattccaacaatgtctcacccatcttggctgccacccaaaagcactggtgagcccctcggccatgtgcctgcacggatggagaccacccattcctttgggaaccccagcatttcagtgtctacacaacagccacccaaaaagtttgccccggtagttgctccaaaacctaagtacaacccatacaaacaacctggaggtgagggtgattttcttccacccccacctccacctctagatgattccagtgcccttccatctatctctggaaactttcctcctccaccacctcttgatgaagaggctttcaaagtacaggtaagagctgaagttaaagtcatgttaggtaagagctgaagttaaagtcatgtttataagccatcctagggagctcatgaatttcatgagtgtttctgtgctggataaacatttatccagagcctattgagagctttacaacttatgaagatctaaggtactttaatgcaacatacccaactcaagcttcccagagttctgctggcttaccctctgaagccctcaaaatacttttgcctactaattttgtttcagatcccaaagcca

SEQ ID NO: 417009 - DNA, 208 bp, Homo sapiens
agggactgaggtcatagattcttggaaaattcatttgtgactgatctagttttctcagctgtatgcaaagtaatctttcaaagactaggttaagattttttttttaagtctgaagcaatgtaaccccaaaaaattataattttaatgatggcattttattttattccattgcagcttgataactttccttatagcaaaggaataacta

SEQ ID NO: 417010 - DNA, 374 bp, Homo sapiens
tctctagtagcccttaatcattgtaccatctctctctaatgcctataagggaactgtttaaatatagtccatatgggaaaagtaacctcaacatgttgtaacagggggcagaaaaacacgctgaatagatgaaaggaacaatctacaggttaattagtagtatggccacaaatatgtgcacagttttgtttcagaaataaagcaagctgtatttgttgtaactatctcttctttgaacttaacagaatgctgataatgccaagctgtgtttacagtccaaatttttgctgaagaccttcaactttgcactctccctgtgtggtatctcttgcccaagacagaacttcaaataaaatcacatagctgatgcaaga

SEQ ID NO: 417011 - DNA, 3264 bp, Homo sapiens
agcgggtacaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaactacgcgatagtctctgttcttcatctgctattaaccttgccttagaaacacataaattatgagatttttttttaaaagttgttaccaaatacacatttcacattgaatcatgtaggatcttgatgggcctttgttcccaaggacttccacatttttgcacagattatgctccatcccattcacttctgcattcctgtaacttttaatccctatgtttgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccatacttattaagttcgaacatgtttcacttaaggagagacacctagcttagtcatggcaagttgccattttgtaaactaaggattttggactgagatttcttaaatctttcttcaaatctcccacaagtatatacttttaaattatggagtattttaagtctacaaaaaggtataaataataatataatgaattcctatatacctaatacccagtttaagacaccaaatataacaagtataattacatcctccaatgtaccgtttccttattccacagatatctttttcactattgtgaagtgatgttcagatttctagttttttttctagtttttaattttaacatcagaactgaaataaaaaattatggatacgtgttttgaattgca

SEQ ID NO: 417012 - DNA, 1622 bp, Homo sapiens
agcgggtacaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagggtggccattcagggcaactggggccttcgtcagttgccccttcattccgcccagaggatgagcttgagcacctgaccaaaaagatgctgtatgacatggaaaatccacctgctgacgaatactttggccgctgtgctcgctgtggagaaaacgtagttggggaaggtacaggatgcactgccatggatcaggtcttccacgtggattgttttacctgcatcatctgcaacaacaagctccgagggcagccattctatgctgtggaaaagaaagcatactgcgagccctgctacattaatactctggagcagtgcaatgtgtgttccaagcccatcatggagcggattctccgagccaccgggaaggcctatcatcctcactgtttcacctgcgtgatgtgccaccgcagcctggatgggatcccattcactgtggatgctggcgggctcattcactgcattgaggacttccacaagaaatttgccccgcgatgttctgtgtgcaaggagcctattatgccagccccgggccaggaggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccggcactgagaagaacgaacacaagaaaaagataagaaatactagagtaaaggccatcaaacta

SEQ ID NO: 417013 - DNA, 1053 bp, Homo sapiens
agcgggtacaggagtttttcaaggctgaccacagtctaggcagaagaaattgcaattgtgaaaggaagatttgcgtgaaagaatggtgtttttggctgagtgaggaatttgaagtatctggaaaatggaagctccactggttcaacagcctctcctccagtttcgaccccagtcacaggacacaagagaatggtcatcccgaaccaaccccctctaacagcaaccaagaagtctacattgaaaccacagcctgcaccccaggctggacccatccctgtggctccaatcggaacactcaaaccccagcctcagccagtcccagcctcctacaccacggcctccacttcttcaaggcctacctttaatgtgcaggtgaagtcagcccagcccagccctcattatatggctgccccttcatcaggacaaatttatggctcagggccccagggctataacactcagccagttcctgtctctgggcagtgtccacctccttcaacacggggaggcatggattatgcctacattccaccaccaggacttcagccggagcctgggtatgggtatgcccccaaccagggacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaagcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacggaccttggtttcaacattgtaggaggagaagatggagaaggaatattatttccttatcttagcaaggagctcacagagctgg

SEQ ID NO: 417014 - DNA, 2488 bp, Homo sapiens
ttcaagggacgtcattcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaacttctttgctttcttatttacgtagatgcattatacctttcatgtaaaattaaagtgaggaccag

SEQ ID NO: 417015 - DNA, 2432 bp, Homo sapiens
  misc_feature (300)..(300): n is a, c, g, or t
  misc_feature (315)..(316): n is a, c, g, or t
  misc_feature (337)..(338): n is a, c, g, or t
  misc_feature (363)..(364): n is a, c, g, or t
  misc_feature (370)..(370): n is a, c, g, or t
  misc_feature (404)..(404): n is a, c, g, or t
  misc_feature (411)..(412): n is a, c, g, or t
  misc_feature (432)..(432): n is a, c, g, or t
  misc_feature (435)..(435): n is a, c, g, or t
ttcaagggacgtcattcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagtnttttttcttttcttnnttttttttgcagatttttttnngattatttttttttttttttaattnntttttnttttttttttttttttttttatttttttgttttnttttttnnttgtttttgttttttttttnttngtttttgtttattttttatttgccttgaaagctagctttgaaacttgcctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttag

SEQ ID NO: 417016 - DNA, 1413 bp, Homo sapiens
ttcaagggacgtcattcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaacttctttgctttcttatttacgtagatgcattatacctttcatgtaaaattaaagtgaggaccag

SEQ ID NO: 417017 - DNA, 423 bp, Homo sapiens
gatgtaagataaagtgtatcaaggaatttcaagtaatttcagtatggcaggggcaatgagagaaaaagagcagatgaggctggcatgttagcaggggccaaatcacagaaggccttgtaggccatacaacaaagatagccactgaaggcttctaaggaagaaagtgatatggttagatttgctttttaaagaccattccagctgcggtataaggggtttggaggtagtaagactagaggcaagaagaacagttaggaggctgttgcaatacttttattccatgtttccctatcccaacagatacttggactaactcgtgcattccagaaattatcaccaccaaagatcccatattcaacactcaaactgcaacacaaacaacagaatttattgtcagtgacagtacctactcggtggcatccc

SEQ ID NO: 417018 - DNA, 639 bp, Homo sapiens
gtagggttgttggtgcactgctagtcttgtaatctttgtcatgtttctatcctgtgctttttcagggtcactgttggcattttgctgatcaaaatggagatagcagtcctctgatataaatttctccctcatctcatctctttcccttcagcccaatcttttctatttcaggacatgcatgtcgtccagccatcagtcaatgactgtcctttgaaaatcaagaaattaaaaaaaattgacatctggggaaaatttatatgctttatttgatttttggttctttgtttttgttggaagagttatgtggtcagcctaaagtctggcctgcaaacatattgtccaatttaaatgaatccattaaggtggtgatgtcttaatgtattagagcatgcatgtgctggcatcactctgaaataaaggtatccagtgtactgtgccaatatgtaccatggccaaaaagtgttatctatcgttatgtgtgagagtctctcactttaatttcatgtttctgcctaaaggtatgtgaaggccttcccttttacaaacaagaatcagcagaaggaaatgatcgaaaccaaagtagtaaaggaggagaaggccaatgatagcaaccctaatgaggaatcaaagaaaactgat

SEQ ID NO: 417019 - DNA, 2419 bp, Homo sapiens
ttcaagggacgtcattcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttggaaggttccagtgagccgacagtttgcagcctattgttacaactcatctgatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtgtccccacggctctgctagtgcttgctctcctcttctttggtgctgcagctggtcttggattttgctatgtcaaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttatttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttag

SEQ ID NO: 417020 - DNA, 464 bp, Homo sapiens
aaaagcccattctttcccccactgaattgcctaggcaaccctgttgaaaaccaactggtcacagacttatggatttatttctagactcctaattctatttcattgttctaaatgtctgtctgtatccacactgtcttgattattgcagctatgtactaagttgtaaaattaggaggtctgagtcatctgcctttgtcctttttaaagacaaagttttggctgttcttcatccttttcatttccatatgaatgttatgatcagcttgccaatttctttcaaaaacaaagctgagatttttaacagggattgcattgaatctgtatatgaatttagatgtattgccatctgtattagctttctatgacttttgtaacaaattagtaccaatgaagtggcttaaaacaacaaattttatcttataatattgtaggtcagaagtcccacatgggtcttaacagcatcc

SEQ ID NO: 417021 - DNA, 929 bp, Homo sapiens
  misc_feature (898)..(898): n is a, c, g, or t
  misc_feature (912)..(912): n is a, c, g, or t
  misc_feature (922)..(922): n is a, c, g, or t
  misc_feature (927)..(927): n is a, c, g, or t
tgggtaacattttatgcagtttaaatgaatggaatattttcctcttctttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaactgtattgtgcattttggcttcacatgtttaactttttttaagaaaaaagttgcatgaatggaaaaaaaatctgtatacagtatctgtaaaaactgtcttatctgtttcaattccttgctcatatcccatataatctagaactaaatatggtgcgtggccatatttaaacacctgagagtcaagcagttcagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttactttccttggtgtttgtagatattgccttgtgtattccacttaaaaccgtaatctagtttgtaaaagagatggtgacgcatgtaaataaagcatcagtgacactctaaaaaaaaaaaaaaaaaaaaaaaaaaaaaaactagttctcctccaataatgtccaaattgtaatgtgccttgcttcaagataaagtgtatttgggaataatattataaacccttacaaattttatgcatgnatctactgcatccntcaactctcnctagnaa

SEQ ID NO: 417022 - DNA, 266 bp, Homo sapiens
ggcagaggttgcagtgagccgagatcccgccactgcactccagcgtgggtgacagagcgagactgtctcaaaaaaaaaaaaaagaaagaaattaatgttggtatattccatagagcttacttagacttcaccagttctatgtgcactcatgtgtgtttatttgcatagctctatgcaattttatcacaggtagcctcgcaaaaccaccaccaaaatcaagatactcacctgtaccatgactgcaagatttcctcatgttacccctt

SEQ ID NO: 417023 - DNA, 590 bp, Homo sapiens
tgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacaacagcaaaagcagctggaggaggctgaggaggagaggacagaggtgcctggggcaacctccaccttgacggttccaggtaggtcctggctgcccagcccggtctttcagtctcggccggcgatctcttagggcctcgccggcttcctcgccccttccctatccattcctatcctcgttcgttcctgtcaccatccctcccgatctctctccccagactggctgcccagcctttggtcccttgatctggtgtcgggaatctgccctccgggtaatgagctttctgagcagctcagagcactgcggtgggttggagaggggtcgggaaggctgggggtgggtgactgcctggattgatctttttcttttccctcccttcttcctgaattctaccctctgc

SEQ ID NO: 417024 - DNA, 896 bp, Homo sapiens
tgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcaacaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgca

SEQ ID NO: 417025 - DNA, 401 bp, Homo sapiens
ggatactttattcaattatatttaaaggagggacctaaactgaaagccagaaacaacagaaaatgttgtagaatctttcacagaggagccaagtgaagtttttccataccctgattttctccctcctacggagcttcagtaccctggacttgcacagatgaggccctcacaaaatctgaaaattggaaagcaacaggggaaccttcagaaagctctattattggaaatggaaagattacaacatatgactatacaaaaagagaggtcaaagttacaaactactttctgtaccccagcagttactgaatgactttcttcctccaaagctatactgagagtgggacagccaaaactttctgattcactgagtcttcagacatctcgtgtagataaaagttgag

SEQ ID NO: 417026 - DNA, 290 bp, Homo sapiens
cctactgaagatacctgggacatgagggagatgcagccaggaggagaaagcacagagtgaattcagagggtccagagtgctgtctgtccctgtgtcttctgcaccctctccctggccctgtggcaccagatgagctccaatcctgcagattaagcatctccgcctgactcttctgtggcctttttgttccccggggtctgcagatggagggcacatagtacagccagcctttatgggggcagcaaagagttaaagcagctccctgagcgccagacaacagcctcatcagc

SEQ ID NO: 417027 - DNA, 234 bp, Homo sapiens
ggaaggcctttctctgttgtttcaaagagaaagagggaagtggcctgggagcagcgtgctggggacctctctagtcttgacaataaaaatgtctccagacattgcctaatgtctccaaggggcaaaattatccctgcctgagaaccactaagagagagagtatataaaaattaaccctctgtcttctatgctaatgcctttaaaatcccaattttaaatgtttattttagtatc

SEQ ID NO: 417028 - DNA, 2408 bp, Homo sapiens
  misc_feature (142)..(142): n is a, c, g, or t
  misc_feature (441)..(441): n is a, c, g, or t
  misc_feature (460)..(460): n is a, c, g, or t
  misc_feature (791)..(791): n is a, c, g, or t
  misc_feature (1023)..(1023): n is a, c, g, or t
  misc_feature (1637)..(1637): n is a, c, g, or t
  misc_feature (2070)..(2070): n is a, c, g, or t
  misc_feature (2112)..(2112): n is a, c, g, or t
  misc_feature (2131)..(2131): n is a, c, g, or t
  misc_feature (2171)..(2171): n is a, c, g, or t
  misc_feature (2207)..(2207): n is a, c, g, or t
  misc_feature (2311)..(2311): n is a, c, g, or t
  misc_feature (2321)..(2321): n is a, c, g, or t
  misc_feature (2327)..(2327): n is a, c, g, or t
  misc_feature (2375)..(2375): n is a, c, g, or t
cattattcacagcagtaacatgcaaatgtatttaaaaatgtttgtgatggagccaggcatggtggctactcgggatgttgaggtgggagcattgctcgagcccaggagttcaagttcatcctaaacgacatagcaagacccngtgcctgaaaaatgtcagtgttggagtatacatgtattagatgtctaccattgagttcatctctttaacattctgtgatgaaataggaaatacatagaaagcatttctcatactgaagtactgtggtttgtctcaagggaaaaaaaagcccttgtatgattgaattttgagatgaacttttccccacttttagaaagagtgactcattgactgtgtgcctgtcaagattccctctggttttctggctagaaagctcacccatttccagtttctaagagtcagttcagtggcagagccancagggacaagtaagactcntgggggtgctttgaccctgcctacctgggagcacacttttcccttccctgatgacctgggatggtggccaggccgtgcccttgctgtcgctgggcagtgtccttttggaaagggagctgccccagggtttagtgcagctgccaaccctgttaggcccggcctctcgaggcctcttccgacttcaagggtcacacacccccaaagatcctctcacccatggtagttgctgtgcatggttctgtctgtccgtgcacctatgcacacacaccaccccaccaccctactctgaaattggcgagtgagttgagagccagctctgtggggtcatccngcagccatggttgtgcctgtccttcatggtggtctttcaggttatcttggcaacatgtacattgcttttctttttttttcttattgtacagtcagtactataaaatttctctttgagttttatacctttgtagcattttagatgacattgtgtttgtactttgttgtgtagagtggaagaattgtgttgaataaacccaagattggaatgcaaaaaaaaaaagagtgactcnttgacaaactggttatttgggtctagctactggcaggaattctctcaaatgaaccaaagaaaacaactgactatattttttgtcagtgataaaattcagggtttcaaataaaaattagattgagaaacttgtaataccactgtgagcgcaatagctttttttcataatgttatgtaatgaatttgatatataagtttcaacacttacatctatataacttagtaaaccactatttccaaagggccattgcatgatgccatataacatgcatgggtacaaattcatttgcgttgaagacattctaatggatttaaagtcacagcacaaaatgttcacgttcatggttatggcttcagttgcacatcgcaccttatctttaagcatcacacagtaaagtgttagagtaggtttcggcagagacaaaaacttacagagatagtcataataatgtcatatgtatgggaaggcagctaccaagtgccttcaatagtggcagaggtaaaagaggatattttatgtgggctttgatggatgcctaagaacttactagaaagaatgggaagaaggatgttttaggtaagggagcagtatgtgtgtgaaagtgtgaaaatacntggcacagggtacttgaatggctatattgccgtgccagagtgttgaggaagactgtaaagatcgattgattcacataggactgacatgatcaaatctgtattttatggttgatataaaaataccctctagacatacagctggtaataattgaaggtaagatttagtgtaaccgtgtgctgtaatcagaagttagattttgatggcttgggtttctgtggcattttaatctaccagttctactggtaactctacgggtttaatctattagctctctcaacttgggtaagttgactatcctctgtgccttttttttttcctgataagtacaatgaagctaagactagcacccactataaatgttctaactccctaacagtgttgcagggaatactacaaactctcagatgttggcagtgaatagaagtgagtttnttcctaggagttgttactccctcagccttcttcctggaagtntggcacactcttgccgctnttcattttactcctgaccttttatattgatggcaaaaatnttaacctgtttatgacaaaatataaaattatttccntaagtggcattaacatgatatatattcacatacttttgagaactactttggattatgcttttgtataagcttacaaagtagctttgctttccttttgtgttttntaaatttttnttaacncaaacttcaacattaaaaaaaaaatctatcgacctttagtgttataanagtgtcctgtctctttaaaaatgaaaaaaaaaa

SEQ ID NO: 417029 - DNA, 1393 bp, Homo sapiens
catatctcctggtaaatgcagtcatacatgatatggctcaatgcctggactgcctgccttgtaaataaccgatggcactcttaataaatgggaaaatgtttttccttagatttcatccacattttatagctaccatagcaaacacactgagtatttcaaaatagcactttgcctttttcctgaatgtgtgctccatgtcatcaagttcatcttactggaaagtttaagtggtgaaattagatggaacatactttgataatgcattgcatgtcaggttataaatatgaactggatttaatatttggccaagatagtcctcacaagtgcgtttggaaacatttgtcaaatgctgaacttagatttctggcctctcctgggagtcatctagatataggaaggcatcttagatgctcacctatacagtctcagtgctaataaaatggaatggcgtgggtgctgggtggtttataatgtgatgcctgtgggtggagaagtaactcacggatcttggccttttcactcttcacagaaactgcgccaaggccaagtcatcacattatacgggcattatgtgctgggggggttggggtgggttgcaggatgggagccttgatgatgaggatgggcagtgatgctgcctccaccagccatcagccaaccacaaccacaatgtacatcctctttgtctgcccttagctttgggactgggtagcagggagagggaaaactataagagcatttcaaagaaggagggaagttaataccttgaaaggagaactgacgtagaagcactccattgtccttacctcaatctggaatgggagattcccatctgtcagatcaggaaggataatgagctttgaaaagcactgaaaggctgggcgtgagccaccacgcctgtaatcccagcactttgggaggccaagatgggaggatcactagagcccaggagttcaagagcagcctgggcaacacggcgaaatcctgtctctacaaaaaatatgaaaaaattagcccggtgtggtggcaggtgcctgtaatcccagatactcaggaggctgatgtgggaggatcatctgagcccaggaggttgaggctgcactgagccatgatcacaccattgcattccagcatgggcaacagagtgagaccctacctaagaaaagaaagaaaagaaaagaaaagcattgggaaaggaagagggtatggtttagaaggcaataagaaatcttaggaagagtggagggtggtaggcacaagggatggtattaataaaggcagagggaaggatacagaggagagggggggaaacacaaggaggatgtgggccgtctggccagaccaccttggtgccacagtggtgaccaaagtaaagaggtgggagaagctgctt

SEQ ID NO: 417030 - DNA, 952 bp, Homo sapiens
catatctcctggtaaatgcagtcatacatgatatggctcaatgcctggactgcctgccttgtaaataaccgatggcactcttaataaatgggaaaatgtttttccttagatttcatccacattttatagctaccatagcaaacacactgagtatttcaaaatagcactttgcctttttcctgaatgtgtgctccatgtcatcaagttcatcttactggaaagtttaagtggtgaaattagatggaacatactttgataatgcattgcatgtcaggttataaatatgaactggatttaatatttggccaagatagtcctcacaagtgcgtttggaaacatttgtcaaatgctgaacttagatttctggcctctcctgggagtcatctagatataggaaggcatcttagatgctcacctatacagtctcagtgctaataaaatggaatggcgtgggtgctgggtggtttataatgtgatgcctgtgggtggagaagtaactcacggatcttggccttttcactcttcacagaaactgcgccaaggccaagtcatcacattatacgggcattatgtgctgggggggttggggtgggttgcaggatgggagccttgatgatgaggatgggcagtgatgctgcctccaccagccatcagccaaccacaaccacaatgtacatcctctttgtctgcccttagctttgggactgggtagcagggagagggaaaactataagagcatttcaaagaaggagggaagttaataccttgaaaggagaactgacgtagaagcactccattgtccttacctcaatctggaatgggagattcccatctgtcagatcaggaaggataatgagctttgaaaagcactgtttggactggcactgtttggactctgggcactgtttggactctgggcactgtttggactctgggcactgtttggactctg

SEQ ID NO: 417031 - DNA, 272 bp, Homo sapiens
cgagctcggtaccctgctccaccgctccaccctacctaagaaaagaaagaaaagaaaagaaaagcattgggaaaggaagagggtatggtttagaaggcaataagaaatcttaggaagagtggagggtggtaggcacaagggatggtattaataaaggcagagggaaggatacagaggagagggggggaaacacaaggaggatgtgggccgtctggccagaccaccttggtgccacagtggtgaccaaagtaaagaggtgggagaagctgctt

SEQ ID NO: 417032 - DNA, 513 bp, Homo sapiens
ctccgttcccccctcctcccccctcccctcagcggtggctcccaagaagtccgagacacgcggtgaggcggcgacgggctccggttgatctcccttttgtgaggtggtttttaagtgaatcattaaagagcaaaggagaagttttcccgtggctcccacgctgctattcaaaacttcctggatgaaatctttagcatcagttgggctcattagcacctctactaagagaagcaagcacagaatggaagggagagcaaatcataactttttaaaaagttatttctccttagttaaaagtttggaagagaagcaagttgaaactgtaggctgattatgtaaaagtttaagttatcagctctcttatatgtaatgcaggttgattataagtttctgggctgttgtgacaacaagaaaattatgtttattattaaaaacttgtttatactgcatatatgtgaagggcattatactgtgacaaagctaacaataaaacatacattttaatatttcaga

SEQ ID NO: 417033 - DNA, 3261 bp, Homo sapiens
tgcgtgcggtgttctagaggatcccgagtagcccacctgactgatccatccacaaattgatggctcattcatatcaatccacaatccatcaaacttcaagctcttctctggctctcgagggttgcatagagctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcagataggctggttgatgctgatggccagcctctacatcacaggagctgccctgtatgctgcccggatccccgaacgctttttccctggcaaatgtgacatctggtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccaggggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417034 - DNA, 3075 bp, Homo sapiens
ctccgttcccccctcctcccccctcccctcagcggtggctcccaagaagtccgagacacgcggtgaggcggcgacgggctccgggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtgataatgacagccaccaaggagatttggagcccattttagaggcatctgttctatcttcccatcataaatttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccaggggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417035 - DNA, 2087 bp, Homo sapiens
ccttacggctaggtacgaggccgggtgttaaatcggccgaaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417036 - DNA, 2078 bp, Homo sapiens
  misc_feature (29)..(29): n is a, c, g, or t
agtaatgtcataaggtacgaggccgggtngtaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417037 - DNA, 1651 bp, Homo sapiens
ccttacggctaggtacgaggccgggtgttaaatcggccgaagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417038 - DNA, 1345 bp, Homo sapiens
ccttacggctaggtacgaggccgggtgttaaatcggccgaaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417039 - DNA, 1140 bp, Homo sapiens
aactaacggctaaggtagcgaggctgggtggtgctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417040 - DNA, 1067 bp, Homo sapiens
  misc_feature (8)..(8): n is a, c, g, or t
  misc_feature (14)..(14): n is a, c, g, or t
  misc_feature (35)..(35): n is a, c, g, or t
  misc_feature (67)..(67): n is a, c, g, or t
  misc_feature (79)..(79): n is a, c, g, or t
  misc_feature (96)..(96): n is a, c, g, or t
ctttgggnttgccncccaataaaaatccctggggnttgtggggtaataaagaccctaaaatattggnggtcccttgaancattgggggcctggttntccctcaagtaaggttgtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417041 - DNA, 1276 bp, Homo sapiens
  misc_feature (341)..(341): n is a, c, g, or t
  misc_feature (363)..(363): n is a, c, g, or t
cccctaacatgtcgcggctccggcacagggtctcttctgaggctgtggccaagatgtcagtggggctgtgggcatcaaaggcatgaccgcccctagaggatgcactctgagaaagcttgttcatgtggctggcaagttcgcactagctgctggcaggaaacaacaaatccctgccatgtagatctctccacagggttgcttgagtatcctcgcagcatggcaactggcttctccagagcaaataattccagagagggcaaggtggaagcctcattgtcttttttatttttgagatggagtctcactgtgtcgcccaggctggagtgcagtggcgtaatatnggctcactgcaacctccgcctnccaggttcaattattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417042 - DNA, 344 bp, Homo sapiens
agataggctggttgatgctgatggccagcctctacatcacaggagctgccctgtatgctgcccggatccccgaacgctttttccctggcaaatgtgacatctgggtaagtatgtcggggtgactgagtgtgtaggtatctgctcatgagttattggcatcctgcagagtgatgcaatagaaaaagttttagacacaaagtcaggagagttgtatcctggtcctaactccctattgagctttctctggacaataagtacaataataactaacatttagtgagcacttccttggtgctcagcatggtacagagtgctttgcacggattacctcattacatacatta

SEQ ID NO: 417043 - DNA, 3936 bp, Homo sapiens
ctccgttcccccctcctcccccctcccctcagcggtggctcccaagaagtccgagacacgcggtgaggcggcgacgggctccgggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtgataatgacagccaccaaggagatttggagcccattttagaggcatctgttctatcttcccatcataaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtatccttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcagataggctggttgatgctgatggccagcctctacatcacaggagctgccctgtatgctgcccggatccccgaacgctttttccctggcaaatgtgacatctggtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccaggggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttataaattatgctaaagccacaaagcacatttttggggatcatagaaggttggggttccagaaaggcatctgtgtgatggttccattgatgtgggatttccctacttgctgtattctcagtttctaataaaaagaaccaaatgaaatatgac

SEQ ID NO: 417044 - DNA, 3909 bp, Homo sapiens
ctccgttcccccctcctcccccctcccctcagcggtggctcccaagaagtccgagacacgcggtgaggcggcgacgggctccgggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtgataatgacagccaccaaggagatttggagcccattttagaggcatctgttctatcttcccatcataaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggttgtgtatccttcctgtgcctggggatcttttatatgtttcgcccaaatatctcctttgtggcccctctgcaagagaaggtggtctttggattatttttcttaggagccattctctgcctttctttttcatggctcttccacacagtctactgccactcagagggggtctctcggctcttctctaaactggattactctggtattgctcttctgattatgggaagttttgttccttggctttattattctttctactgtaatccacaaccttgcttcatctacttgattgtcatctgtgtgctgggcattgcagccattatagtctcccagtgggacatgtttgccacccctcagtatcggggagtaagagcaggagtgtttttgggcctaggcctgagtggaatcattcctaccttgcactatgtcatctcggaggggttccttaaggccgccaccatagggcagataggctggttgatgctgatggccagcctctacatcacaggagctgccctgtatgctgcccggatccccgaacgctttttccctggcaaatgtgacatctggtttcactctcatcagctgtttcatatctttgtggttgctggagcttttgttcacttccatggtgtctcaaacctccaggagtttcgtttcatgatcggcgggggctgcagtgaagaggatgcactgtgatacctaccagtctccagggactatgaccctaaaccagggcctgcggcacttgcgggcctccctgctggctactgatgccagtaccagaggagccccaaaactttgacagcctcgtgggctttgtgacggcccaggggctctgcgtggtacatgactgagaagagaaaaacaaaaataaatcatacctcaaaggatggagtgcatcaattgggagaaaaggagacatagcccaaaccctggcttattcttgggatctactgattgcgggctctgcaagacccttggcaaactggcttctgatccatatcatatttatttgtagaagatggcgaaacagtttagctggtggttctttcttctccctttctctctctctatgacaataatacaaaccaatttaagtgaacatttatatccgataaggggtgggagtgtgattttaaatgctcttttgggagaacaaagaaattaatgtaaataagatttctaactgtttaaataagactttatataaatgtttaaaacataggggtaagggagggagggagaatttttgtatagaatgaaacatgcaagtaccacacactgtttgaattttgcacaaaaagtgactgtaggatcaggtgatagccccggaatgtacagtgtcttggtgcaccaagatgccttctaaaggctgacataccttggaccctaatggggcagagagtatagccctagcccagtggtgacatgaccactccctttgggaggcctgaggtagaggggagtggtatgtgttttctcagtggaagcagcacatgagtgggtgacaggatgttagataaaggctctagttagggtgtcattgtcatttgagagactgacacactcctagcagctggtaaaggggtgctggaggccatggaggagctctagaaacattagcatgggctgatctgattacttcctggcatcccgctcacttttatgggaagtcttattagagggatgggacagttttccatatccttgctgtggagctctggaacactctctaaatttccctctattaaaaatcactgccctaactacacttcctccttgagggaatagaaatggacctttctctgacatagttcttggcatgggagccagccacaaatgagattctgacgtgtccaggtttctcctgagctcatctacatagattggtagacccttcctttggattaggaaagatgagttttacctctggtacactgtcttggtaagcctggatgtgacagacacctcggctctccttgaataagaaagccagcagaactcttaaagccagttgtagtacggagttgtcagcactcactgaacctcactttacagggataagagtggtgtggcattttaaatacaatggtatgttattgccagggagtgaggtacaagacgatggctcatgtcacaggcctacctgatacggtgtcagagaaagtggtggggaaaggatctggttcatggaattctgatcttggcccataggtgaaccaccaaaatagtgctcgagtcttaggttactgtcatcaaagacttgggatgactccattatatcctggggttgtgggtattagaactaaatatggaggtcctgagcatggggactggtgtcctcagtaggtgtttgggaatatgggaagggtctcctatttattcaatagagttttctcagttattttcctcccttgcccttgcaatctccagcaaaaggtgggatctaggaagaaagaatccagtgtagaagttgagaagaacttgaacgttttggttctggataaggtcactgtcctaggtgctaggtggaccgagcaaaagactcagtggatgaactggtgcagtgcctgacagaataaagaacagtattaatccctttgagaaagcatagtccagcaggacagtggccatttggacagaagcccacttagtttcttgggagcaacagcacgtatcagaagccagacttgctcttcggtcatgcactttgggatacagcgtataggtgcagccctgtcacaacaccaacagaagtagcagcctctgggtgcagtcacccacaccccaaagctggaaggatctggttcaacatagcacaaacccttaggaaaaatgaaattaacatcactgatgtgtaatccagtaaaatctccctttttcgggtgtgtatgtgggcatgtgcccatttctatgtgtgtgtctacgtgcagctcactaccaacagcctcatgtgcacttgacctgacagtgctcgctgagaactctcaccaggttggcgcctgaatgccttactctcagcagtcagaggcttgcttgctctgtgcagatttttaattttcttttttggccctaggctggttgggacctctacagcttcattctttcaccattaaatagtggcctttttcagtattttccctcttcccctttatttttggggatcatagaaggttggggttccagaaaggcatctgtgtgatggttccattgatgtgggatttccctacttgctgtattctcagtttctaataaaaagaaccaaatgaaatatgac

SEQ ID NO: 417045 - DNA, 1622 bp, Homo sapiens
ctccgttcccccctcctcccccctcccctcagcggtggctcccaagaagtccgagacacgcggtgaggcggcgacgggctccgggatcaactcactatcctgaaggtccattctcccaagaagaggggacagaaagacagatctatttgtaagaaaggcttgggtatcccatgaacgagccaacagaaaaccgattggggtgcagcaggactccagagccagatataaggctcagaaaagggcaccaactggatggtacacgaagaggtgataatgacagccaccaaggagatttggagcccattttagaggcatctgttctatcttcccatcataaaagctctgaggaacatgaatacagtgatgaagctcctcaggaagatgagggctttatgggcatgtcccctctcttacaagcccatcatgctatggaaaaaatggaagaatttgtttgtaaggtatgggaaggtcggtggcgagtgatccctcatgatgtactaccagactggctcaaggataatgacttcctcttgcatggacaccggcctcctatgccttctttccgggcctgttttaagagcattttcagaatacacacagaaacaggcaacatttggacacatctcttaggtatgtaatgtcagtgatgtaatgagctggtgattcactttcttcctttttattttcatgtatttgagggtaagcacagaacttcagaaatgtatttggatttgccattttgttttctgaatttctaatgatgaattttctgactggtttactcgtagtttatcctggtttgcactatgattttgttataacttaagttatatttctttctactagattttcagatcttgtcctcaaaccaggccaagtaaaagttgctatacaaaatgtggtttcatattgtagtgaccactgagaagaaagtattatttaatagaagtaatctgatcttttaaaatgcattacttatatgcactgctaattttcagtttggcctgaagtagaatatggactgtaattttttctccataatgattgtatattaaagaaagaatactgtagaggaaagaatagtctttccaacaaatggtgctgggataactgagccatatgtaaaagaatgatcccgaactcacatatgcaaaagtgaacccaaaatggatcaaagacccaaacataagagcaaaaactataaaatccttaggagaaaacatatataaatccttgtaagtttggattaggtgactgtttctgagaattgccaccaaagaaaaaatagataaattggacttcatcaaaattaaaaacgttggtatatcaaagtgcattatcaagaaagtgaaaagacaacccatagagaagagaatatttacaaatcagctagttggtaaggatctaataaataactcctacaactcaacaataaagacaaccgattttaaaaatgggtaaaacatctgaatagatgttcttccagagaagatctaaaatggccaataagcacatgaaaagatgtttgtcttcgttaggcatttaggaaaacgcaaatcaaatgctttgagaaatgcagtgagaaatctcaacacttcacacccactaagatggctataatc

SEQ ID NO: 417046 - DNA, 1414 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaactgacccacgcgtccgcgacgcgtgg

SEQ ID NO: 417047 - DNA, 310 bp, Homo sapiens
taaatgcaaaattcctagccattcatagagtttaagctgttaatcgttcttgctgcttgctaatttgtctgactgcaggtctctaatgttcctagagcgtccttaattctggtttatcttcttgctaaaggaagaaaacctgccttttgacatggctgcagatcacaggtgtatttgaaacgctgtttcttgaatctttgaattcagtcattgacagtcgttcataatcggacaacagatttttccccccagtctttggactcaggggaagggtcagatagaagtactcactatagacaggaattccagc

SEQ ID NO: 417048 - DNA, 3976 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417049 - DNA, 4810 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaagaatgtgtgtttttaaaaactcagttatacctatgtgtgaagtgacacattttagaactttttcattcagggattgattttgacttgtaggcatagtagggcaaggttcttttaagcttttcctagaacgtttttcagcagcagtttatgaaattcatcgtttgccacgaataaagatgacatcctagaatggaccgactgtaccgtgtatatgaacaatacctcttatgagtatagttccggcttaagattttaaagcccctgaagaaaaatgaacctatagagcatagcttgctgaggaatacaatttggatattaaccacagagaggtgtagcagaataccaagatgacagccacatgttaacctcctccctatccttcactgtcaggatcttctgctttataatgctgagataatgccaaagaggaagtagggataattctttttccagtctgttgtcatgggcaattctacctgcagatatcctagtgtgagaatgctgaatccagaatgatgtctccactttttcccctagcatgcgcatggcaaggcatatctaagcttcctcaccgtgtcaggatatggctttagaattttacattggcacttaggaggcaactttgtcatccctgttgtaatgtgcttttttgtttaactggcttgggatgtgggtcagaaacccttattgaaacttgtggggattattttagtttcttttcaagctaaagactttatatcttgccatttttcttgggacctaccctctccttacctcaaatgtaaaaatacacaaaccaaaataaaaggcaggtgtatggaatcaaaagaacta

SEQ ID NO: 417050 - DNA, 3538 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417051 - DNA, 3922 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417052 - DNA, 3922 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccagcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417053 - DNA, 3923 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417054 - DNA, 1730 bp, Homo sapiens
ggcagaaacttaatacaaaagctctcttttcagaaaatatctgaaatatgtaattgtgtccagtgtacatgtttcatttcagtgatacattttctgctgcttgtagggctcaactgccacacacaactattattattattatgttttcaagttcagtttttagactgatcattcacaaagggtggttttcagtctgctgagatcttgcttttctttttgtgttcacagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417055 - DNA, 1399 bp, Homo sapiens
aactttcgtttggtgcgtgagctcgcggaggtacgagaggatggctcgtagtcgttagctagatgtatcatgggcatgcctgaagtgcgtggctgtttcatcacactacacacacttatgcaccgcagaatgtctaccagtttgtgactctactgcccaaagtactgagcaggtgtcagaagctcccattacctggtactcttgtcctagagcagtgatgtctagagcgcatgtctacggcaaatgatcacatctttggcaacccgtcagtctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417056 - DNA, 432 bp, Homo sapiens
tggataaagtaaatgaatgtcacttatctgataggcccaggagccccaagttatcttggaacatcaagaggagaggaatcacccaacttgtatgtatttgatggtacaaatcgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417057 - DNA, 2998 bp, Homo sapiens
  misc_feature (119)..(119): n is a, c, g, or t
atttgtataaaactggaagtgtgtgtgtgtgagcatgggtaccatttgataagagaaatgcatttgattgtgaagaagggagagttaaattctccattatgttcgtggtgtaaagtttngagctggaatttattataagaatgtaaaaccttaaattattaataaataactattttggctattgaaaaaaaaaaaaaaatattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417058 - DNA, 4336 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaaaaaaaaaaaaaaaaaaaaaaaaaaaaaaacactgtgtgtggggcgcggcccggggcccccagaaaaagctcttctgaaacccccccgctgtggggcgcgcgcgcgggcccccatgtggtggtaaggtcaaccgcgggcgccacaagcggtggtcccccaagaggagaaaactccgggcgccaggagacaagagcggcgcgggggagtttcctccccacaatataaaaaaaacgcgccggggggggaccaccgaggcgtttctctgagaacaatcccccagagagggggcccagagggggcaaaaaagggggagcccataccacaggggaggccacaagggacagcaaatataaaatagcg

SEQ ID NO: 417059 - DNA, 3922 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaatttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417060 - DNA, 3814 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatcaaaaaaacctcaacatacaaacaggaaactataattacactttggtcgagaagccagccatcaggcccccatatgaacacaggcttatatagcaccaatccggtttggggcccagcgccccacagaacgcaaaaggtagaccttgggccttacccgt

SEQ ID NO: 417061 - DNA, 3705 bp, Homo sapiens
gagtgcccggcgctggacaaagggaggaggcggcggcaggagagggctggggaggccccctctgacatgcctccctgccaactgtaaccaatcgtcgagcccccctgccgagcccccgcagcctgcaggtcttgcgggaggacttcctcacgcctcgcccatggcggggactgctggcccggcccggcgcgtcccagcacacctcgctcaggcagccccgccagaccggctcccccgtcagaagccgagctccttgcccagaaatcattaaccagcgcgacctcccagcaggcgatggtggtggtggggcggggggagagatatagattcccccgaacaatggcttgtaactccccacgccgccggagcggaatacagtaaaagcactggactgacctaagagtttgtttctgcactctacattgttttaatgaaaataaaatgttattttaagaaaaaaggttttcttctgattttctgcacaaccagacgtttgtttgtttgctttaaaatgtttcaacaaaatcctggtttgtttcgaaatatgttggattagcatttaacacctcatcggtcactaaagcccagtcagttcaccagccccaacacagcctcggctaaaagaacatcagagcaaacagagctgggcctttaaaagtggcaaacaaatgccacacaccgcctaaagaaggggggtttgggggaggggagggttaaggcgaacttgggtccaaatgagtttgaagggaatacaaagaacgaaaagtcagcacaagttttcctaaagctagctcgcgaacgcaagcgtcgcgaacaagggcttttgtgcatgctaattgcgccattggtgcgcaaaagttccgacgcgaagtgtgaactctcaacagaaggaaacatgagacaactgaagtgccctggtttatgtgccctgctcctcctccgctgccgcctccccttctttctccttcctcccgccgagcccgctgttgcagcttgtttgcactggggcttatccggagcggaaattcctttccgtttttgtgaatgacaaactcattaacaattcatcaacacaacctgttccagccggcccgtccccacggcaacagccccttccgcagcacgctcattggctggcccggagaatgtatccattgagacgctcgctgtttgtatccattgaggagctgcctcgcgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagcacggagtccgaattaattggatttcattcactggggaggaacaaaaactatctgggcagcttcattgagagagattcattgacactaagagccagcggctgcagctgggtgcagagagaacctccggctttacttctgtctcgtctgccccaaccgctagcctcggcttgggtaaggcgaggcggaattaaaccccgctccgagagcggcagcttcgcgcgcggtgcgctcggcctatgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaatgaagactaattcaattttgcatatagaggagccaaagagagatttcagctctgtatttgtggtatcagtttggaaaaaaaaatctgatactccatttgattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctcttttctaatccaaagggtatatttgcagcatgcttgactttaccaattctgatgacatctttacggacactattatcactaagaccttgttatggcgaagtctttagtctttttcatgtattttcctcatgattttttctctttatgtagtttgactatgccttacctttgtaaatatttttgcttgtgttgtcgcaaaggggataatctgggaaagacaccaaatcatgggctcactttaaaaaaagaaagaataaaaaaaccttcagctgtgctaaacagtatattacctctgtataaaattcttcagggagtgtcacctcaaatgcaatactttgggttggtttctttcctttaaaaaaatttgtataaaactggaagtgtgtgtgtgtgagcatgggtacccatttgataagagaaatgcatttgattgtgaagaagggagagttaaattctccattatgttcgtggtgtaaagtttagagctggaatttattataagaatgtaaaaccttaaattattaataaataactattttggctattgaa

SEQ ID NO: 417062 - DNA, 767 bp, Homo sapiens
cttatagatggttctgtatgtagggggttcgtaggatgcttgtggtgtttcttgcgccgggctgcggttcttacaagctgtgaaaactactacggcttctcaggttagatgattgcttttctcgttctggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcataggtgagactaattaatagtcgtcgctctgacatttaaatgcaaaattcctagccattcatagagtttaagctgttaatcgttcttgctgcttgctaatttgtctgactgcaggtctctaatgttcctagagcgtccttaattctggtttatcttcttgctaaaggaagaaaacctgccttttgacatggctgcagatcaca

SEQ ID NO: 417063 - DNA, 422 bp, Homo sapiens
agccaaaacaatcttgaaaaaaggaacaagatataaaactacaataagtaagactatgtgagactgacataagatagacatagattgagggtctaaaactttggccaggcacagcaggtcacacctataaccccaacactttgtgaggctgaggtagaaggattgcttgagcccagaattcgagaccaacctaggcaacatggtgaaattccatttctacaaaaatacaaaacttagttgggcatggtggtgcacacctgtaattccagctacttgagaggcgaagtaggaagattatttgagcctgggaggttggggctgcagtgaacagtgaacatgctactgcactccagcctggtgacagcgtgagacctcgtctcaaaaaacataaaaataaacctttacatgtattgtcaaatatg

SEQ ID NO: 417064 - DNA, 3432 bp, Homo sapiens
caggaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaaccagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcgtgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtcaagaggtgatctgtgccattttgtgtgtgattcttttattgtcgggtctctagggatttttctggaaggaatgttggtgagaatgcctctctcacctcaatgccaactctgtgaagggccaaaccattgtcttgctcatccctgtactctcaacacagcgtgtggcatatgacaggtgttcaaaatatttggtgaggaatgaatgaatgagtggctaaatcagccaccccctacccccacagcccacccaaaatggagctaggcctcctccatcagactatatctcctccatatcccactttcttgtgaggtccagaataaattctcatccccaaagggcccaggatgcccccattctgcctaccagttactctcgatac

SEQ ID NO: 417065 - DNA, 3636 bp, Homo sapiens
  misc_feature (3465)..(3465): n is a, c, g, or t
  misc_feature (3568)..(3568): n is a, c, g, or t
caggaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaaccagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcgtgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgaaaaaaaaaaaaaaaaaaaaaaaaaaaaaaaaaaaaaaaaaaaaaaaaaaaaaaaaaaaaaaaaaaaaaaaaaaaaacctcgggccgaattcggcacgagtagtctcgattttttttttttttttttaactgcccatatgcaaagaatttatggaggatccattcaattttaaatggcttgaaaataagaccataggtatgcaatttttttttacagggttggacattattttaaaataggccctacatagatatcttcgggaaatgaaaattttttctccagtggttactactttaagggactactcatgaggaaggaattatacaaggttcttggctggccacttcacatatggagaacccttttggcttaactaggactaattttatgttgcccccatgggtgaatccttaaaaaaatagcanttcaaatcccctacaggattattttggaatgtcctgttttgggcttaaatgcatggaagcaagcttcttaatgttgaggggttacccatggaccaatttggtngggaaatcattttgcaagtcctctagggaccttttcaaccaatttgcatgcttaaaaaagctttggca

SEQ ID NO: 417066 - DNA, 3378 bp, Homo sapiens
caggaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaaccggcccctgtcaatctggtttttgtcactatggacttaccaattctgaatatttcccataaaccagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcgtgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtcaagaggtgatctgtgccattttgtgtgtgattcttttattgtcgggtctctagggatttttctggaaggaatgttggtgagaatgcctctctcacctcaatgccaactctgtgaagggccaaaccattgtcttgctcatccctgtactctcaacacagcgtgtggcatatgacaggtgttcaaaatatttggtgaggaatgaatgaatgagtggctaaatcagccaccccctacccccacagcccacccaaaatggagctaggcctcctccatcagactatatctcctccatatcccactttcttgtgaggtccagaataaattctcatccccaaagggcccaggatgcccccattctgcctaccagttactctcgatac

SEQ ID NO: 417067 - DNA, 3378 bp, Homo sapiens
caggaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaaccagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcgtgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtcaagaggtgatctgtgccattttgtgtgtgattcttttattgtcgggtctctagggatttttctggaaggaatgttggtgagaatgcctctctcacctcaatgccaactctgtgaagggccaaaccattgtcttgctcatccctgtactctcaacacagcgtgtggcatatgacaggtgttcaaaatatttggtgaggaatgaatgaatgagtggctaaatcagccaccccctacccccacagcccacccaaaatggagctaggcctcctccatcagactatatctcctccatatcccactttcttgtgaggtccagaataaattctcatccccaaagggcccaggatgcccccattctgcctaccagttactctcgatac

SEQ ID NO: 417068 - DNA, 2777 bp, Homo sapiens
  misc_feature (121)..(121): n is a, c, g, or t
gaattcggggcaagggacaaaaatacagcaacaagagaaaaaactcacagaggcagaaagagacggggacaaaaagagagaaacacatcaaagagatgtggagagagatagaaacagagtnaggaagactaaagagaggctgagagagatgagttagagatacgcggttggatgtgtagaggacagagaaaagcaaactgggccagatagtgtcaaagacctttaggccaacggagggcagccagggagatgggcgtatacacagcaagctacagcctcccctgaccctccccttccttccctactgtggacgcaggagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaaccagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcgtgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtcaagaggtgatctgtgccattttgtgtgtgattcttttattgtcgggtctctagggatttttctggaaggaatgttggtgagaatgcctctctcacctcaatgccaactctgtgaagggccaaaccattgtcttgctcatccctgtactctcaacacagcgtgtggcatatgacaggtgttcaaaatatttggtgaggaatgaatgaatgagtggctaaatcagccaccccctacccccacagcccacccaaaatggagctaggcctcctccatcagactatatctcctccatatcccactttcttgtgaggtccagaataaattctcatccccaaagggcccaggatgcccccattctgcctaccagttactctcgatac

SEQ ID NO: 417069 - DNA, 521 bp, Homo sapiens
accagtcacggaccctggacccagcgcacccgcaccatggccggccccagcctcgcttgctgtctgctcggcctcctggcgctgacctccgcctgctacatccagaactgccccctgggaggcaagagggccgcgccggacctcgacgtgcgcaagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccggacggctgccacgccgaccctgcctgcgacgcggaagccaccttctcccagcgctgaaacttgatggctccgaacaccctcgaagcgcgccactcgcttcccccatagccaccccagaaatggtgaaaataaaataaagcaggtttttctcctctaccttgact

SEQ ID NO: 417070 - DNA, 276 bp, Homo sapiens
tgacatttcctgcagagaaagtctgtaaggaaccctgactccaggctgtttctcgttaaggtgctgtgcttcctgttttgttcattatagttttgaaagattcatattatagccaattttcccagaaaagtttagtttataataacctagaatcagcaatttatttctagttaaaatgttactgccttccacagtctcactgggagagggtctggatcatttctcctcaggaaatcactgccttgagctgaaatatactggaatcctgctacttcc

SEQ ID NO: 417071 - DNA, 3267 bp, Homo sapiens
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtaatggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagcctcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatccccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctga

SEQ ID NO: 417072 - DNA, 525 bp, Homo sapiens
ctgacatttggaggcagggcgtatttaggtaataaatcagcatgtaaagcatctatgacatttctgacggggataagcagtagaaaggaaagcaagcggagacaggagctgctgggatagaaagagggggaggcatcatctgaaatcaagcattctcctctgagctgtcacctggagagataggctgtaaacatcccagggctgagtcagacctaccagccacctttccaatattggaaaaatctataattcaagatgttcatggccagggtaaaatttcctacctaagacaattgcatggggagccttttgcccaaggctgataagtgacagggaccagctgtttgtcccacccgtatggactcccaaggccatgttctcaagcaccatccacgaatcctccgtgcacatccgtggctcactgccatgggcgcccctatgtgctcttttctcctcccagtcccagccatcaagacggagcccacggatgaatatgaccccactctgatctgcagccccacccat

SEQ ID NO: 417073 - DNA, 247 bp, Homo sapiens
actatgagacagaaggcagccgaggggctgtcaaagctccaactggaggccaccctgtggttcaggtatggacttgaatgctcttccttttgtgtgtggtgtttgtcactaagagattcacttctgctgacccactgtttgttgcttgttaaggtgaggtatgtgtctcagcctcttactcctttgaggaatgagaaatatgagattaaattagcattagaagctaatccagctactcataagccag

SEQ ID NO: 417074 - DNA, 3355 bp, Homo sapiens
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtaatggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagcctcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatccccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgagctgatagacacacaccttagctggatacaaaacatattatgaaacagaatgactgtgatctttgatccgagaaatcaaagttaaagttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctga

SEQ ID NO: 417075 - DNA, 1070 bp, Homo sapiens
aactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaacaatacacagaaaccttttttgaaaattaaaaacattaagaaacttcttgtaattcacaaataattgaaattaagtaattttctcagcttaagagtttgtattttttaagtgaatatcagtaattaatccattaacattgatgctctatttctgcttttaagtttgaactgaggctgatcaatgttcagtcaattctcctttgggattggtgtcaatcaaagacaaatcacaacaagtgattgtccagggtgtccatgagctctatgatctggaggagactccagtgagctggaaggatgacactgagagaacaaatcgattggtcctcattggtaagtctcaaaggattcacagttttaaaacaaagtgaaaaatatatttgaaagggatatcatgtgccacttaaacagattaaccattcaggtcctcttttaaaactaaataagcttgtggtcaatgtttcatctttatcatgttacaacgttcgtaaaagcttgttaggacttttgttcttcttcagttttagaaaagtggttaatccaaggaccaatgtgactttgatgtactgacctggaaagttaaagatggaatcactcaattgctattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417076 - DNA, 1338 bp, Homo sapiens
agtcagtgtcaaaatattttttggagttagcctgactctggagaggtcagtaaaataaacagttgcactgagaggccagattagcaagtatgggtttctaaatgataaactgctttttggctagaatcagggctgaatcagccttcccaccacttatttgtttctagggtgtttgaaaggcctagtactgagttcacgtggtgcatgattgtgggctggggtgcagggaagtattttagattctaatatgggggtttggtgtgaagggaagtatattagattctaagaaactatatttcagtggttatcctttttttaaaataagtaataatgaatatttagaaccagaacagttttgtaagaaggaaaatacctaaaatctgaactgtaatcttctatgtttttatgacattatgtgaatcaaaggggttttccttttaagtaaaagaaaaggtcaggagtatgaaatcctaagccctcttcctccccctataaaaccccacaggttcacttgtagaaaaaaattgcaaatgaggaagaaaaatgctttcagctagaaaagttagttttggatttgtgtattcagtaacagaacatgttgaagtttttattaaatgcaagaaaatgtctctaaagtaaaatcctttgtgttgacattagattttttattgtattatagtaactttattcaaacttttttttgtttaggcatttaacagaagagaaacctgatggccttatcaatgaagctactagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417077 - DNA, 683 bp, Homo sapiens
aactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaacaatacacagaaaccttttttgaaaattaaaaacattaagaaacttcttgtaattcacaaataattgaaattaagtaattttctcagcttaagagtttgtattttttaagtgaatatcagtaattaatccattaacattgatgctctatttctgcttttaagtttgaactgaggctgatcaatgttcagtcaattctcctttgggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417078 - DNA, 1584 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattaggtacaaaatgataagtgtgttaagtgcctacagatccatattgtatacacagaatattttttactctgattgttgccctgtagaaacttaaggcataaggttgacctgcttcaagaacgttagggaatcacatatattgttgatggctaattgttatataaatggtaatacataaaattagtcctcagtgcttgcagaatatagttcacagttaatagactgatattcagggtcttcgcactccatctttcttttcctgtcttctctttgactctttcctaatgtcagtcttccctaactttacccaggatggttaattcactttcccatggatgcatcctctcagttcctgtctttactcataatgtattctcactctgccaatccctgagttctttcttgttctgttttttttttttttaaatttattctatagagcctattctgtctctccccgcttcctatgtgaagtcttccctgactcaagtggtctcagttttccctgaactcttgttgacttcatcttccttaactgtcaaccatgccttgtcttccagcttgctttaatatcttctttgtccatagccaaggctgatcagcataggacaatcaggacaatatgaatgatgctcaaatatgtgctaacagtcattttgctgactgttctggagactcccattccttttgaaaacaaagatggacttttcaaatgaagttatagttcagggactttgttttgaattattttgtaagacctgaactaataaaagccc

SEQ ID NO: 417079 - DNA, 1305 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417080 - DNA, 1393 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417081 - DNA, 1425 bp, Homo sapiens
agtcagtgtcaaaatattttttggagttagcctgactctggagaggtcagtaaaataaacagttgcactgagaggccagattagcaagtatgggtttctaaatgataaactgctttttggctagaatcagggctgaatcagccttcccaccacttatttgtttctagggtgtttgaaaggcctagtactgagttcacgtggtgcatgattgtgggctggggtgcagggaagtattttagattctaatatgggggtttggtgtgaagggaagtatattagattctaagaaactatatttcagtggttatcctttttttaaaataagtaataatgaatatttagaaccagaacagttttgtaagaaggaaaatacctaaaatctgaactgtaatcttctatgtttttatgacattatgtgaatcaaaggggttttccttttaagtaaaagaaaaggtcaggagtatgaaatcctaagccctcttcctccccctataaaaccccacaggttcacttgtagaaaaaaattgcaaatgaggaagaaaaatgctttcagctagaaaagttagttttggatttgtgtattcagtaacagaacatgttgaagtttttattaaatgcaagaaaatgtctctaaagtaaaatcctttgtgttgacattagattttttattgtattatagtaactttattcaaacttttttttgtttaggcatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417082 - DNA, 1662 bp, Homo sapiens
  misc_feature (1523)..(1523): n is a, c, g, or t
tcaaatcacgtgaagatcagggtcctagagtaacctaatattttgtacattggttatttgactcctcatttttatattacatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagttttttttccttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggaaaaaaaaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgaaaaaaaaaaaaccaaaaacataaaaaataaaaaaaagaaaaaaaaaacataaaaacaacacaaccaataatccaaaaaaaatattatatcaacaaaccaanatcccacagggtggtgaactgggaaaaaaaacactcgggggggggtccccaacccaagtccctctaaaaaaaggctgacttttgcgcggcattggtgaacattttttcaatctgggaagggggaaaacacctgtgtttt

SEQ ID NO: 417083 - DNA, 2324 bp, Homo sapiens
  misc_feature (512)..(512): n is a, c, g, or t
  misc_feature (2185)..(2185): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggtaagtctcaaaggattcacagttttaaaacaaagtgaaaaatatatttgaaagggatatcatgtgccacttaaacagattaaccattcaggtcctcttttaaaactaaataagcttgtggtcaatgtttcatctttatcatgttacaacgttcgtaaaagcttgttaggacttttgttcttcttcagttttagaaaagtggttaatccaaggaccaatgtgactttgatgtactgacctggaaagttaaagatggaatcactcaattgctattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggaaaaaaaaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgaaaaaaaaaaaaccaaaaacataaaaaataaaaaaaagaaaaaaaaaacataaaaacaacacaaccaataatccaaaaaaaatattatatcaacaaaccaanatcccacagggtggtgaactgggaaaaaaaacactcgggggggggtccccaacccaagtccctctaaaaaaaggctgacttttgcgcggcattggtgaacattttttcaatctgggaagggggaaaacacctgtgtttt

SEQ ID NO: 417084 - DNA, 1145 bp, Homo sapiens
agtcctttccccctcccgtcctgtccccatcagtgttgaaatgtatgctacagttattatggttgtaatttgttatgccatgttgatcttcttgtgcttttcatatcagaacaatgcatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctaagcaatactagaatggttatatatatatttaagtttgtattaaacctgttggaatggtaaagaaatttactgacatatttaaccatacaaaatagtgttgctaaaagactagtttttctctttattctgtgcatatgtatatatatgaatgtgtgttttttttaagaaattttaaaaaaacttaatctgccagcttttctctattggaatttgcaaacaacttgtaaaattggaattacagaatattagaatagtcagttatggaaagtcacttcattatccttgtgtcactaaataacgtataaagttaaatcagaagtgtattatctctgaatttctaatcagttgtttttagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417085 - DNA, 1161 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417086 - DNA, 1346 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagtttgaactgaggctgatcaatgttcagtcaattctcctttgggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417087 - DNA, 1558 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgcgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtacacaaagtttttggtaaattaag

SEQ ID NO: 417088 - DNA, 1315 bp, Homo sapiens
  misc_feature (1176)..(1176): n is a, c, g, or t
aactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaacaatacacagaaaccttttttgaaaattaaaaacattaagaaacttcttgtaattcacaaataattgaaattaagtaattttctcagcttaagagtttgtattttttaagtgaatatcagtaattaatccattaacattgatgctctatttctgcttttaagtttgaactgaggctgatcaatgttcagtcaattctcctttgggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggaaaaaaaaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgaaaaaaaaaaaaccaaaaacataaaaaataaaaaaaagaaaaaaaaaacataaaaacaacacaaccaataatccaaaaaaaatattatatcaacaaaccaanatcccacagggtggtgaactgggaaaaaaaacactcgggggggggtccccaacccaagtccctctaaaaaaaggctgacttttgcgcggcattggtgaacattttttcaatctgggaagggggaaaacacctgtgtttt

SEQ ID NO: 417089 - DNA, 1327 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417090 - DNA, 1248 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417091 - DNA, 1937 bp, Homo sapiens
  misc_feature (512)..(512): n is a, c, g, or t
  misc_feature (1798)..(1798): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggaaaaaaaaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgaaaaaaaaaaaaccaaaaacataaaaaataaaaaaaagaaaaaaaaaacataaaaacaacacaaccaataatccaaaaaaaatattatatcaacaaaccaanatcccacagggtggtgaactgggaaaaaaaacactcgggggggggtccccaacccaagtccctctaaaaaaaggctgacttttgcgcggcattggtgaacattttttcaatctgggaagggggaaaacacctgtgtttt

SEQ ID NO: 417092 - DNA, 1692 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggtaagtctcaaaggattcacagttttaaaacaaagtgaaaaatatatttgaaagggatatcatgtgccacttaaacagattaaccattcaggtcctcttttaaaactaaataagcttgtggtcaatgtttcatctttatcatgttacaacgttcgtaaaagcttgttaggacttttgttcttcttcagttttagaaaagtggttaatccaaggaccaatgtgactttgatgtactgacctggaaagttaaagatggaatcactcaattgctattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417093 - DNA, 1564 bp, Homo sapiens
  misc_feature (1425)..(1425): n is a, c, g, or t
cgtgtgtgttcaagggtcaactgcattgccctttcatgacaacctttggtttgggagggtttttggttttgtttggttttcatcttttgagtaataagctgcttggaaaagtttctgttctttagctgattttttagctataaaaatgtatttgaaaagctcataaatttcaggattgaaaagataattgaaagtttaaaaaaaacctaattcattgaagtaataaccaaataattttcaatcttgattcaactgtgattcaaatcttacaccatttgcccacttctatgaattttatgtataaaattttttaagagtcagagttttttttccttgattaattggatgtatttcacagaatttccaactgctcacgttagttttcttccttttagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggaaaaaaaaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgaaaaaaaaaaaaccaaaaacataaaaaataaaaaaaagaaaaaaaaaacataaaaacaacacaaccaataatccaaaaaaaatattatatcaacaaaccaanatcccacagggtggtgaactgggaaaaaaaacactcgggggggggtccccaacccaagtccctctaaaaaaaggctgacttttgcgcggcattggtgaacattttttcaatctgggaagggggaaaacacctgtgtttt

SEQ ID NO: 417094 - DNA, 1807 bp, Homo sapiens
  misc_feature (512)..(512): n is a, c, g, or t
  misc_feature (1668)..(1668): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggaaaaaaaaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgaaaaaaaaaaaaccaaaaacataaaaaataaaaaaaagaaaaaaaaaacataaaaacaacacaaccaataatccaaaaaaaatattatatcaacaaaccaanatcccacagggtggtgaactgggaaaaaaaacactcgggggggggtccccaacccaagtccctctaaaaaaaggctgacttttgcgcggcattggtgaacattttttcaatctgggaagggggaaaacacctgtgtttt

SEQ ID NO: 417095 - DNA, 514 bp, Homo sapiens
cgctctattagcgtaactatcgcggtgcagagaggaaaggaaaaaacctagctgcaacgactctcttaatttttccaccgctacacagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactggg

SEQ ID NO: 417096 - DNA, 1162 bp, Homo sapiens
  misc_feature (512)..(512): n is a, c, g, or t
tgcgcgtacggcgtgttggtcccagcggttcagctgaggtagggacgtgccgtaggccggaatgttaccggctgttggatctgtggatgaggaagaggatcctgcggaggaggattgtcctgaattggttcccattgagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatctggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgatgacatactgttagagaccactggattagcagaccctggtgcagtggcttctatgtttngggttgatgctgaattagggagtgatatttaccttgatggtatcataactattgtggattcaaaatatggattaaaagtgaaataccactaaaggcagaagagaatgaaatcatcccacccactgacccgttcccaatctgagcatatggatagggcccaaagcacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaaggtactttaaaaaagctattcctattaataacaaatcattttagttattaataataaacattaagtaattgacaaatatgcttgattctgatataagaaagatctaagtgcatttaaaaagaattggatccaaaatgttgtttggaatgctcttaataagttagtttggcatatttggctagtacatttgcctgtcttcaaaactaagattacaaagccatgataacactgtgtaagtgtttgcttaatgaggaagaaaagacttccaaacactcgagagggtaactcagtacagaaatctgaagta

SEQ ID NO: 417097 - DNA, 3292 bp, Homo sapiens
aactccgtggagtccccgcaggcagagacgcggagtgggggtggcgggtcgccggatcgggtgggaagtaaaagacccccaggagtgggtgcgggctcactgatacggctgtgagcggcattggagtgtgcgtgggtcttctcgctacgctcgggcccgcaagaggggtgtgagagcggctaggtccaagcaggtgatgtttgcagacagaaaaagtaaactgtcaaggaattcagagcattgggtacttgttatttggaccagtttgaagcatctttgatttattggaccaactggcaacagaaaatgaaaagtagtgtggcacagataaaaccttcttctggtcatgacagaagggaaaaccttaattcatatcagaggaactcctctccagaagacagatatgaagaacaagaacgatccccccgggatagagattactttgattacagcagatcagactatgagcattcaagaagaggacgttcttatgatagtagcatggagtcacgaaacagggaccgagaaaaacgcagagaaagagaaagagatacggatcggaaaaggtctcggaaatccccatctcctgggaggagaaacccagaaacatcagtaactcagagttcctctgctcaggatgaacctgctacaaagaaaaagaaagatgagctggatcctcttcttactcgcactggtggagcatatattccccctgcaaagctcaggatgatgcaggaacagattacagataaaaacagcttagcataccagaggatgagttgggaggccctgaagaagtcaattaatggccttatcaacaaagtcaacatttccaacataagtattattattcaagagcttcttcaagaaaatatagttagaggaagaggactgctgtccaggtctgttttgcaagcacagagtgcttctccaatcttcacccatgtttatgcagcattagtggcaattatcaactcaaaatttccacaaattggagaattaatcctcaaaaggttaattcttaattttcgaaaaggctatcgaagaaatgacaagcaactttgcctgactgcttcaaaatttgtggcgcatcttattaaccaaaatgtggcacacgaagttttatgcttagagatgctcactttgctcctggaaagaccaacagatgatagcgttgaagtagctattggttttcttaaggaatgtggcctcaaattaacacaagtgtcaccaagaggaatcaatgctatatttgaacgccttcgaaacattctgcatgagtctgaaattgacaaaagagttcaatatatgattgaagtgatgtttgctgtacggaaagatggattcaaggaccaccccattatcctagaaggtcttgatttggtggaagaagatgatcaattcactcatatgctccctctggaggatgactataatccagaagatgttcttaatgttttcaagatggatcctaattttatggagaatgaagagaagtacaaagctattaagaaagaaattcttgatgagggagatactgactcgaacacagaccaggatgctgggagtagtgaagaggacgaggaagaagaagaggaagagggagaagaagatgaagaaggacaaaaagtaactattcatgacaaaacagaaattaacctggtctcatttcgtcgtacaatttatcttgctattcagtcaagtttagattttgaagaatgtgctcacaaattgctgaaaatggagtttcctgaaagccaaacaaaagaactctgcaacatgatacttgattgctgtgcccaacagaggacatacgaaaaattttttggcttattagctgggcgattttgcatgctaaagaaagagtacatggaatcctttgaaggtatattcaaagaacagtatgataccatccatcgcttggaaacaaacaagttgcgaaatgttgctaagatgtttgctcaccttttatacactgattcacttccatggagtgttcttgaatgtataaaactgagtgaagaaaccactacatcatccagtagaatttttgtcaaaatatttttccaggaactgtgtgaatacatgggtcttcctaaacttaatgcaagattaaaggatgaaactctgcagccattctttgaaggattattaccccgagataatccaagaaacactcggtttgccatcaacttctttacttctataggtcttggaggtttaacggatgaactgcgggagcatctcaaaaatacaccaaaggtcattgtggcgcagaaaccagatgttgagcaaaataaatcctccccatcctcttcctcttcagcgtcctcctcttcagagtctgactcatccgactctgattctgacagcagtgatagcagttcagagtcttccagtgaagagagcgactcttcatccatcagtagtcatagctctgcctcagctaatgatgtaagaaagaagggacatgggaagaccagaagtaaagaggtagataaattgatcagaaaccagcaaacaaatgataggaaacaaaaagaaagaagacaagaacacgggcaccaggaaacaaggactgagagagaaagaaggtcagaaaaacacagagatcaaaattcaagaggttcaaattggagagatcctataacaaagtacacatcagacaaagatgttccttctgaacgaaataactacagtagagttgcgaatgacagagaccaagaaatgcatatagatttggaaaataagcatggtgatcccaaaaagaagagaggagagagaagaaattctttttctgaaaatgagaagcatacacaccgaattaaagacagtgaaaatttcagaagaaaagatagatcaaagtcaaaggaaatgaatagaaagcactcaggctcaagaagtgatgaagatagatatcaaaatggtgccgagagacgatgggaaaaatctagcagatactctgaacaatccagagaatcaaagaaaaatcaggaccggcgaagagaaaagtctccagcaaaacaaaaataattctacaaaatgacataaactggacatgccttatattcagttgaaacaaattattttttactttgacgaactttatagagaattcttgtataaagtattggtttgtatttgtaaatttaaaaaatgttttcattttaacatgttttataattgatacatctcaaggccctacccataaaattatttgaaaactttcaccagaaagggatgtaagtctcgcttatattttgtgaataaaatgatcaaaagctcaaaaatt

SEQ ID NO: 417098 - DNA, 2546 bp, Homo sapiens
catttccgtcagcacaggcgctggatttcggactttgtagttcatgccaacttctcttttttgtcgccattttggcaacaagacagtgtgcctggatcgactactttgactctggtattatgatatggtatttgaaataaattaaagggataacgtgtcaagccaattgagcgtcaagtttttaaatatttcactattcgccttcttcctaccgtcggtgctcgggaagaggaagtgacgtacgtccggtgtaatggcggcgcggtggagctctaggtgatgtttgcagacagaaaaagtaaactgtcaaggaattcagagcattgggtacttgttatttggaccagtttgaagcatctttgatttattggaccaactggcaacagaaaatgaaaagtagtgtggcacagataaaaccttcttctggtcatgacagaagggaaaaccttaattcatatcagaggaactcctctccagaagacagatatgaagaacaagaacgatccccccgggatagagattactttgattacagcagatcagactatgagcattcaagaagaggacgttcttatgatagtagcatggagtcacgaaacagggaccgagaaaaacgcagagaaagagaaagagatacggatcggaaaaggtctcggaaatccccatctcctgggaggagaaacccagaaacatcagtaactcagagttcctctgctcaggatgaacctgctacaaagaaaaagaaagatgagctggatcctcttcttactcgcactggtggagcatatattccccctgcaaagctcaggatgatgcaggaacagattacagataaaaacagcttagcataccagaggatgagttgggaggccctgaagaagtcaattaatggccttatcaacaaagtcaacatttccaacataagtattattattcaagagcttcttcaagaaaatatagttagaggaagaggactgctgtccaggtctgttttgcaagcacagagtgcttctccaatcttcacccatgtttatgcagcattagtggcaattatcaactcaaaatttccacaaattggagaattaatcctcaaaaggttaattcttaattttcgaaaaggctatcgaagaaatgacaagcaactttgcctgactgcttcaaaatttgtggcgcatcttattaaccaaaatgtggcacacgaagttttatgcttagagatgctcactttgctcctggaaagaccaacagatgatagcgttgaagtagctattggttttcttaaggaatgtggcctcaaattaacacaagtgtcaccaagaggaatcaatgctatatttgaacgccttcgaaacattctgcatgagtctgaaattgacaaaagagttcaatatatgattgaagtgatgtttgctgtacggaaagatggattcaaggaccaccccattatcctagaaggtcttgatttggtggaagaagatgatcaattcactcatatgctccctctggaggatgactataatccagaagatgttcttaatgttttcaagatggatcctaattttatggagaatgaagagaagtacaaagctattaagaaagaaattcttgatgagggagatactgactcgaacacagaccaggatgctgggagtatgaagagagcgactcttcatccatcagtagtcatagctctgcctcagctaatgatgtaagaaagaagggacatgggaagaccagaagtaaagaggtagataaattgatcagaaaccagcaaacaaatgataggaaacaaaaagaaagaagacaagaacacgggcaccaggaaacaaggactgagagagaaagaaggtcagaaaaacacagagatcaaaattcaagaggttcaaattggagagatcctataacaaagtacacatcagacaaagatgttccttctgaacgaaataactacagtagagttgcgaatgacagagaccaagaaatgcatatagatttggaaaataagcatggtgatcccaaaaagaagagaggagagagaagaaattctttttctgaaaatgagaagcatacacaccgaattaaagacagtgaaaatttcagaagaaaagatagatcaaagtcaaaggaaatgaatagaaagcactcaggctcaagaagtgatgaagatagatatcaaaatggtgccgagagacgatgggaaaaatctagcagatactctgaacaatccagagaatcaaagaaaaatcaggaccggcgaagagaaaagtctccagcaaaacaaaaataattctacaaaatgacataaactggacatgccttatattcagttgaaacaaattattttttactttgacgaactttatagagaattcttgtataaagtattggtttgtatttgtaaatttaaaaaatgttttcattttaacatgttttataattgatacatctcaaggccctacccataaaattatttgaaaactttcaccagaaagggatgtaagtctcgcttatattttgtgaataaaatgatcaaaagctcaaaaatt

SEQ ID NO: 417099 - DNA, 1049 bp, Homo sapiens
  misc_feature (991)..(991): n is a, c, g, or t
catttccgtcagcacaggcgctggatttcggactttgtagttcatgccaacttctcttttttgtcgccattttggcaacaagacagtgtgcctggatcgactactttgactctggtattatgatatggtatttgaaataaattaaagggataacgtgtcaagccaattgagcgtcaagtttttaaatatttcactattcgccttcttcctaccgtcggtgctcgggaagaggaagtgacgtacgtccggtgtaatggcggcgcggtggagctctaggtgatgtttgcagacagaaaaagtaaactgtcaaggaattcagagcattgggtacttgttatttggaccagtttgaagcatctttgatttattggaccaactggcaacagaaaatgaaaagtagtgtggcacagataaaaccttcttctggtcatgacagaagggaaaaccttaattcatatcagaggaactcctctccagaagacagatatgaagaacaagaacgatccccccgggatagagattactttgattacagcagatcagactatgagcattcaagaagaggacgttcttatgatagtagcatggagtcacgaaacagggaccgagaaaaacgcagagaaagagaaagagatacggatcggaaaaggtctcggaaatccccatctcctgggaggagaaacccagaaacatcagtaactcagagttcctctgctcaggatgaacctgctacaaagaaaaagaaagatgagctggatcctcttcttactcgcactggtggagcatatattccccctgcaaagctcaggatgatgcaggaacagattacagataaaaacagcttagcataccagaggatgagttgggaggccctgaagaagtcaattaatggccttatcaacaaagtcaacatttccaacataagtattattattcaagagcttcttcaagaaaatatagttagaggaaggagggactgctgtcccaggtnctggtttttggcaagggcacaagaagtggctttcttcccaattcttttaaccccatgg

SEQ ID NO: 417100 - DNA, 3375 bp, Homo sapiens
catttccgtcagcacaggcgctggatttcggactttgtagttcatgccaacttctcttttttgtcgccattttggcaacaagacagtgtgcctggatcgactactttgactctggtattatgatatggtatttgaaataaattaaagggataacgtgtcaagccaattgagcgtcaagtttttaaatatttcactattcgccttcttcctaccgtcggtgctcgggaagaggaagtgacgtacgtccggtgtaatggcggcgcggtggagctctaggtgatgtttgcagacagaaaaagtaaactgtcaaggaattcagagcattgggtacttgttatttggaccagtttgaagcatctttgatttattggaccaactggcaacagaaaatgaaaagtagtgtggcacagataaaaccttcttctggtcatgacagaagggaaaaccttaattcatatcagaggaactcctctccagaagacagatatgaagaacaagaacgatccccccgggatagagattactttgattacagcagatcagactatgagcattcaagaagaggacgttcttatgatagtagcatggagtcacgaaacagggaccgagaaaaacgcagagaaagagaaagagatacggatcggaaaaggtctcggaaatccccatctcctgggaggagaaacccagaaacatcagtaactcagagttcctctgctcaggatgaacctgctacaaagaaaaagaaagatgagctggatcctcttcttactcgcactggtggagcatatattccccctgcaaagctcaggatgatgcaggaacagattacagataaaaacagcttagcataccagaggatgagttgggaggccctgaagaagtcaattaatggccttatcaacaaagtcaacatttccaacataagtattattattcaagagcttcttcaagaaaatatagttagaggaagaggactgctgtccaggtctgttttgcaagcacagagtgcttctccaatcttcacccatgtttatgcagcattagtggcaattatcaactcaaaatttccacaaattggagaattaatcctcaaaaggttaattcttaattttcgaaaaggctatcgaagaaatgacaagcaactttgcctgactgcttcaaaatttgtggcgcatcttattaaccaaaatgtggcacacgaagttttatgcttagagatgctcactttgctcctggaaagaccaacagatgatagcgttgaagtagctattggttttcttaaggaatgtggcctcaaattaacacaagtgtcaccaagaggaatcaatgctatatttgaacgccttcgaaacattctgcatgagtctgaaattgacaaaagagttcaatatatgattgaagtgatgtttgctgtacggaaagatggattcaaggaccaccccattatcctagaaggtcttgatttggtggaagaagatgatcaattcactcatatgctccctctggaggatgactataatccagaagatgttcttaatgttttcaagatggatcctaattttatggagaatgaagagaagtacaaagctattaagaaagaaattcttgatgagggagatactgactcgaacacagaccaggatgctgggagtagtgaagaggacgaggaagaagaagaggaagagggagaagaagatgaagaaggacaaaaagtaactattcatgacaaaacagaaattaacctggtctcatttcgtcgtacaatttatcttgctattcagtcaagtttagattttgaagaatgtgctcacaaattgctgaaaatggagtttcctgaaagccaaacaaaagaactctgcaacatgatacttgattgctgtgcccaacagaggacatacgaaaaattttttggcttattagctgggcgattttgcatgctaaagaaagagtacatggaatcctttgaaggtatattcaaagaacagtatgataccatccatcgcttggaaacaaacaagttgcgaaatgttgctaagatgtttgctcaccttttatacactgattcacttccatggagtgttcttgaatgtataaaactgagtgaagaaaccactacatcatccagtagaatttttgtcaaaatatttttccaggaactgtgtgaatacatgggtcttcctaaacttaatgcaagattaaaggatgaaactctgcagccattctttgaaggattattaccccgagataatccaagaaacactcggtttgccatcaacttctttacttctataggtcttggaggtttaacggatgaactgcgggagcatctcaaaaatacaccaaaggtcattgtggcgcagaaaccagatgttgagcaaaataaatcctccccatcctcttcctcttcagcgtcctcctcttcagagtctgactcatccgactctgattctgacagcagtgatagcagttcagagtcttccagtgaagagagcgactcttcatccatcagtagtcatagctctgcctcagctaatgatgtaagaaagaagggacatgggaagaccagaagtaaagaggtagataaattgatcagaaaccagcaaacaaatgataggaaacaaaaagaaagaagacaagaacacgggcaccaggaaacaaggactgagagagaaagaaggtcagaaaaacacagagatcaaaattcaagaggttcaaattggagagatcctataacaaagtacacatcagacaaagatgttccttctgaacgaaataactacagtagagttgcgaatgacagagaccaagaaatgcatatagatttggaaaataagcatggtgatcccaaaaagaagagaggagagagaagaaattctttttctgaaaatgagaagcatacacaccgaattaaagacagtgaaaatttcagaagaaaagatagatcaaagtcaaaggaaatgaatagaaagcactcaggctcaagaagtgatgaagatagatatcaaaatggtgccgagagacgatgggaaaaatctagcagatactctgaacaatccagagaatcaaagaaaaatcaggaccggcgaagagaaaagtctccagcaaaacaaaaataattctacaaaatgacataaactggacatgccttatattcagttgaaacaaattattttttactttgacgaactttatagagaattcttgtataaagtattggtttgtatttgtaaatttaaaaaatgttttcattttaacatgttttataattgatacatctcaaggccctacccataaaattatttgaaaactttcaccagaaagggatgtaagtctcgcttatattttgtgaataaaatgatcaaaagctcaaaaatt

SEQ ID NO: 417101 - DNA, 239 bp, Homo sapiens
gcggccgcctactactactactactgctcgaattcaagcttctaacgatgtacggggacatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaa

SEQ ID NO: 417102 - DNA, 1141 bp, Homo sapiens
tgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtaggagacgtgcacttggtgctgcgcccagggaggaagccgcaccaccagccagcgcaggccctggtggagaggcctccctggctgcctctgggaggggtgctgccttgtagatggagcaagtgagcactgagggtctggtgccaatcctgtaggcacaaaaccagaagtttctacattctctatttttgttaatcatcttctctttttccagaatttggaagctagaatggtgggaatgtcagtagtgccagaaagagagaaccaagcttgtctttaaagttactgatcacaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaa

SEQ ID NO: 417103 - DNA, 704 bp, Homo sapiens
acaggacgttgctttttcactgtttcctattaatcttcagctgaacacaagcaaaccttctcaggaggtgtctcctaccctcttattgttcctcttacgctctgctcaatgaaaccttcctcttgagggtcattttcctttctgtattaattataccagtgttaagtgacatagataagaactttgcacacttcaaatcagagcagtgattctctcttctctccccttttccttcagagtgaatcatccagactcctcatggataggtcgggtgttaaagttgttttgattatgtaccttttgatagatccacataaaaagaaatgtgaagttttcttttactatcttttcatttatcaagcagagacctttgttgggaggcggtttgggagaacacatttctaatttgaatgaaatgaaatctattttcagtgaaaacttgttgactttgagttttgctgtgtttgtggctagagttttgggatatttagtacagagtgaatctcacaccatatcattgggaagcctgaataaccttcatattctcccatttttacaactctatcagaactgtacgggtataacggaaatgtttaggaaccattatgctcgctcttccctgtttgggagcagacaagaaggaagagtagcctggtggcagtggcaacgatataagtacataaggaaaagcagataaacttcag

SEQ ID NO: 417104 - DNA, 2376 bp, Homo sapiens
aaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatagagatttagcctgattttactctaataatatttatgggggggttattacttttactccttt

SEQ ID NO: 417105 - DNA, 2369 bp, Homo sapiens
aaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417106 - DNA, 1899 bp, Homo sapiens
gtcctgggcctgccagctgagtccccaagaccctggccagtgccgctgggttcccggggctccccgagctaaccccaggcctgtgggctctgttttctggagcaggcgcctggtcagggacacctcctcagcccaagtcctcattttatgcatttggtgtttttcaattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417107 - DNA, 2414 bp, Homo sapiens
aaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417108 - DNA, 2346 bp, Homo sapiens
aaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggtgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417109 - DNA, 2183 bp, Homo sapiens
aaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417110 - DNA, 2461 bp, Homo sapiens
aaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417111 - DNA, 2844 bp, Homo sapiens
ctgatgaaagaatgtcccaggagattcctcctaattaaatgctgactgaggaatctgaggagggggggaaggggtgtcaggagtgggaggccattaatgacacgttggaagacaaacaggatgttgattcacctgtaaagatctccaaggcctgacctcagagttgagattaaggaaagaatattcctcgagttggacttaagcatggatctggtggaagagtccctgcctggattattagacttgtgtggagtgagcacctgggcttgcagagtgtgggggtctggagaggagttgggtggggagatttaagggggaggagttcccaagaaaccacagaagctttgggtgcctgagaggttgggagagcaccctgctaaagcatcctatctggtagggaggggagctcttgacagacgggttgttagggagggtggtgaaagccacgcacatcaaggggctggcttgattgccctctggccccacatctaagcttctgggctgtgactgcccccaaccaagtcctcagagcccagcttgggacccaccacccgccatactccacgctcccaagcccttactctgctgttccaagggccgacctgctgccacaaagttctctttctagacagcccggtgtgaattctcacttcctcctgggacttcctccagcaggactgtggctgtggatgaaacaggcgcctatttaatcgacagagaccccacctactttgggcctgtgctgaactacctgagacacggcaagctggtgattaacaaagacctcgcggaggaaggagtgttggaggaagcagaattttacaatatcacctcattaataaaacttgtaaaggacaaaattagagaacgagacagcaaaacatcgcaggtgcctgtgaagcatgtgtaccgtgtgctgcagtgccaggaggaggagctcacgcagatggtgtccaccatgtccgacggctggaagttcgagcagttggtcagcatcggctcctcttacaactatgggaacgaagaccaagccgagttcctctgtgtggtgtccaaggagctgcacaacaccccgtacggtacggccagcgagcccagcgagaaggccaagattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417112 - DNA, 2089 bp, Homo sapiens
aaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaaatccttcctgtaccgcttatgccaggccgatcccgacctggactcagacaaggatgaaacaggcgcctatttaatcgacagagaccccacctactttgggcctattttgcaagaacgaggctcaaggatgtgagggacacagtattgacagctgaagaaatgatttacgttttcccgagatgtaatgaactgccatgtccaggaagcttggctgtgagaagaaacctgcttttgatcatttttctagagatctgggtgtgaatccttttttgcctctgaggtgggtggtgagagacgggcccagctgtccaaggccagacgtccccaagttgggggagcacggcggccgggtgggcgctgcctcttgggggggcctcgctctgttttttccaagtgccacgtgggactgaggcagacactcccagtcagcccgctcgatcctgaagatcgtgtgaaggaagcgttcttggtgctacacacagtctggaaaagcagcctgggcttcactggcaggaagcggccgcagccgcgtcagtgtccagcacgtcgtggcctctggtccgaccaccaggccctagtctcggtcagggagtctgctctgcctcccaggcgggatcgctggtttctctcgacctcgcagagctcctgacaaaggcggcttctgcgtcgtcactgcttcccggcgccattccgaggccgggccttcttctgacacgggctccaaccccacctgaccaagcccgggacagtcaaggcttctcaatttgtattttccaggcaagagaactttgtaccccttctctgtgtggatagactccccagcgtttttcctctggaaatgcccacagggcttgccgcgtggagactgatctgttccatccgttagcgcgaggtagcagtgtcgcctcgcccctcccactgcgggctcacggggagctggcgtctgtcagtgccttgtcacgcctggcatagaggttgggctggaggcctgtccactggcttctggagctgaaggtctgcgtcacggtgaaaattcgggatgtttacagagcatcacaaatgcctctctctcgccgctctctcattttctttgtataactatgcagccttccctctctttctgggatgtttgggacttcactcgacctgcacgggctctgcccgacatgccgtgggagctgctgggattcctttagaaaccgctgcccgcatgctttgaaaacagacctttctcagctggctgtggggacctgtcagagtctggggactcggcgtgcagggcgggctccaagcgctttgcttccggaactccggcttcccaaggggtactgtgcagactgaccaccggcctcccgcctgcaggtcagaggctctgacactgtctggtttccaatgcttctggagacttcctgcctaggcctcatcctcctctttgccagtcacctgattaaccaattctccagcattaggacttacctccttctttttgtaaggtctcttgtatgttgttaaatgtttggcttaaacaatttataaaagcctttctagaaggcagacttagccccagcagagcctgggaggaaggcggccgctggggctcctgggcatcctctctggggagctgctggccgcttagcgttgtttgatttttgaccttgacatagtagataggcttgtggtttttttaatttaaagatattaagacttaattcactaaaatttattctaaggggatatttatacttttatacttttttaggtatcgtattttatcagcttacagtttaatgcctaagtttcccctggaaatagcaaataaaattgtgtatttatgaa

SEQ ID NO: 417113 - DNA, 263 bp, Homo sapiens
tggaggaaggaaattacccacctctggccatcctgtcccatgtaagggtggtgatgggagggagggctgagaagctcttgtgaaggtcacagcccagaggcacaggctccctaaaggactcagacctaatcacaggactacagaacctttccccttcccacacatgttacttatagtactgcaggcctctttacagcagttacagttacttttacctggtacatcacatctggttatcaagaaaaaatttcagctggacctat

SEQ ID NO: 417114 - DNA, 302 bp, Homo sapiens
agccaagtgcagggctgggacaggacttcacaaccagaaggatcaagagtggcctgcaagtcttggagtcgctcctggggaggccctgagtttgttgttctggcaaggccccaccccagggatgtgcttgccacccggtggaaggctttaaatgaaacaagcagtcaagaacatgggctctgggccaggtgtggtggctcaggcctgtaattccagcactcggggaggccgagacgggaggattacttgagcccaggagttcgaaaccagcctggacaacatggcaagacgtcatcaatatt

SEQ ID NO: 417115 - DNA, 994 bp, Homo sapiens
  misc_feature (244)..(244): n is a, c, g, or t
  misc_feature (822)..(822): n is a, c, g, or t
  misc_feature (958)..(958): n is a, c, g, or t
cagtgcggcacctgtcctggcaggcactgtatccaccagaggagagaccctcggcaaaccctcagacggccaggagggtcagcgcgggcactggtgcccacttggggtgaagacttgggttactgtctgctgggccttgcgaggggcttgggagggtcatgggggcactgcacttccctgagcagggagcacggggttagaaggggcagggctgccgcgaggggctggaggctggagggaggtntggggtgcctctggtgggtgaagctgggagcagagaccgtcgcattgggtgtgtcggagccgttcgagggtgggggtgccagcaactgctgtgccagggaccttgaactggctgagcatggaatggaaatctgggcctcggtgcctggaggggcctgagagctggggtcctctgcagacgtcctcggcagcacccagcacagtcgggccttaggactggaggtacacagcggccaccctgagctcccacagcagtgctgtctctcaggcacctctcccttcaggaacccaagccctgaaccccaacacccctgagctcggaccccaaatccagccctggcctaggagatggtggccttttgctctccccactttaaggaaagctttggggtggaagtgacactgtgctccttgctgaggaagaggttgggttccacagcagcagacgtgcggggccttggaagttggggggtggggaagctcctctcgattaaatgctgagcctgtcgttttccccaggtcagtggccccgcgtccccaacgtggtggtgtgcagccccaggggccagcagagggcgngcttgcttttctcctttaagtccgaaactgactcccggagaatttatagacatgtgggagcccactggcctcgccgctggtgtgtggccgcgtttgtgggtgctggtcaacaccttgctccacaaggaaatacttntgtgagttgtgacgaaaatatactttttgcaatgcg

SEQ ID NO: 417116 - DNA, 345 bp, Homo sapiens
gaggaaatgatacttaatctgacatcagaaaggtgaatgagatttatctaaataaggtgggtgtaaagataatgaatgtggaaggtaggttgtatcattataattaatgtttgctcattaacaatgtacccaaataagaggtaccaaataagtctgggatctaagagaattatttatagttaaggagagaattaaaataagccaataaatagagttaatttgggagctatttcatgtaatgtattgagtatgcttttattcttgaaaatctatttctataaatgtagtaaactgaactttatacatttcacatagctcgatatttattcttcagaagaatttttt

SEQ ID NO: 417117 - DNA, 443 bp, Homo sapiens
ccttaagacattgtaggaaggtgcttagtttattcttctttaagctatgatgagaaatgagatttctggtataaaaaatctaaaccaaactccctcaaaaatatgagtttaagccaattaaatcctcccttaattggcaataactcaataaacattcaatctccttttaagtattggaaaatgtttaatctctactaagttttcctttttctggaataagctgtccctactgttttagtctttccctctgggcttttgggttattttccccactgtgaactgctccctatttgaacttaatctcttggggctttgtagattcttagttttattaatgtcattctaatccttgaggaataatttattatctttgataaatttacaactatttctactcagtgaattcatgattacatatttcattcagcaaaattgtattttag

SEQ ID NO: 417118 - DNA, 150 bp, Homo sapiens
aggctcacgtactttcctaactgccttgctgcggcttactgccaacgtccaacatcttcttgctcttctctgctatctccaaagttatttcacttatcttcaatgaatgtctgttaatctgatacctgcatgactcaatactactttact

SEQ ID NO: 417119 - DNA, 611 bp, Homo sapiens
gaatttcattctgttcctgacagcgtccttgactagctgtttgatcaccccgagcaaagttacataccagctttcaaccgttgggagggcagcggcgtcctttttctcaagtgccttctcctgggtcgggctttatgcctgcagcagggcgtttcaaacggctgaggccatcccttgttagggagagaaacctcccgggcaggggtctccctcaatgaggaagccctccacttccccccactcgtcccactgttcgtgattttaatctgcttttgtggcgcaggaagaaagaaaattaattttcgcccgtctgtgtgtagggagcatttcagtggaaacccggtttgaaatgcatgttctgttgatttcggcagcctgcgccggctggggttttgagatgcagcattctcaggggaagaggtgatgggccacaggccttcgtggggtgggaactcaggctccccgtgggccctggacggggtcctcatgtcctgtgctccgtcttggcaggagtaagagttgatgatgttcatgctctcccaactcacccatctctgccatggttgcttttttttttttttttggttaaagcaagcatattttgctgttgc

SEQ ID NO: 417120 - DNA, 440 bp, Homo sapiens
agagcaacgtctgtctcagagcgactcccacagcgtccttagcaaccagccttggttcccagcggctcagagcgcagcggaatttatggatttatgaatatgcctgttaacaaatcaccttatgattaatacatgtggaggcatatcttccccttatcatgaagagctctggaaattaaattttcaacatttaagtggagaaaggggtcataaatcaagattatttccttgggataaagtttctacaatgagtgcaagagcaattgaaaagaactttcacaaagactttacagtcacaaataatatactttttctagttgttttctgtgctatccttgtcccaataccatagtgatccatattgtaaaaaaaagtagcaggagaagttgttatccacctagaatcctacagagaagaaaataaaattcaaaatatatcat

SEQ ID NO: 417121 - DNA, 343 bp, Homo sapiens
tggccagggctgctgcactggggaccctggtggaggatttcgctggaaacgcaggtgggaccagaccatgaagagtctcaaacacagacttgaggactctgacctttatcctgggggcagcaagaagccatgttaggtgaaggaacaaggctgtttctccctcagcactagtgcaaggaaaggccagggaggccctcagtggaagcttgctgctggatttgttgatgtgccttttctcctgcctgcactggggtcagaatggccttgggtactgcacacttcctaccaggaatagaaggccccacagctatagcacctctcttccttttagttctttggaagg

SEQ ID NO: 417122 - DNA, 1552 bp, Homo sapiens
  misc_feature (421)..(421): n is a, c, g, or t
  misc_feature (540)..(540): n is a, c, g, or t
  misc_feature (1041)..(1041): n is a, c, g, or t
gagaattcatacaggtgagaaaccctacaaatgtaatgagtgtgaaaaaaccttcagccacagatcatcccttctttctcatcagagaattcatactggagagaaaccttacaagtgtaatgaatgtgagaaggcatttagcaacagttcaacccttatcaaacatctgagagtgcatactggagagaaaccgtatcgatgtagggaatgtggtaaagcctttagccagtgttcaaccctcactgtacatcagagaattcatactggagagaaactctataaatgcggcgaatgtgagaaggccttcaactgtagagcaaaacttcacaggcatcaaagaatccatacaggtgagaaaccctataaatgtagtgagtgtgggaagggatacagccagtttacatctctagctgaacatcanaggtttcatactggagaacaactgtatacatgcttggaatgtgggagaaccttcacacgtattgtaacccttatcgaacatcagcgaattcacactggacaaaaaccttatcagtgcancgaatgtgagaaagccttcaaccagtattcatcctttaatgaacatcggaaaattcatactggggaaaaactttatacatgtgaggaatgtgggaaagcctttggttgcaaatctaacctttataggcatcagagaattcatactggagagaaaccgtatcagtgtaatcagtgtggaaaggccttcagccagtattcatttttaaccgaacatgagaggatccacactggagagaaactgtataaatgtatggaatgtgggaaagcctacagttacagatcaaacctttgtagacacaaaaaagttcacacgaaagagaaactctataagtggaaggaatatgggaaacctttcatctgcagctcctcacttacccagtatcagagattttttaaaggagataaagcctatgaggtttagttcatctctcaaataatccaagacttctcactggggaataagggaataataaatagggtacaaactcctaatagatttgncttttttacttctcctgaaggaaatatgttagttgccactaagtcatgataaaattgatcagtgagactatgaagagcactgacttgttaaattttaaaagaaccataaattctaaggtatctaaaaacctatgagtatttaattcatagaaaaaatgtaaaaggtctttttaaaaatcatgaaaaatagttgaatatacattttgtttctctcataagaccatattccctttaaaagagtaagcttcaatatgtgaattttcttttaaaaacagtcactgagttaataatgtaaataagtgtgtggccttctttaaaatagctggctaacataggaggcacttcttttcataaagagaagctaaacataaaaaggaattttaaatttaactcttcacatggaaataataaagctctttatatgagctgtcccaccagcaacttatatatgtaaacatacatatatacacatatgcatgtgtgtgtgtaaacataaaagtcctttattatt

SEQ ID NO: 417123 - DNA, 679 bp, Homo sapiens
aaggaaatgaatttgatagcagattgttagagattaattacctatcatatgccaaagccacttcctacatgtcagtgctaaggaatcccctagagatggaattcctaggttcaactgaaaattaattgtaattaatataataggttaattcattgtaattatttttaagccttttggcaatgagttaattccacaagatccacattgcttgaagtgtcacagagaacacttgatgagaatgttctagtaataaaccttaaccctctggggaaaaaatcctactgtctttccttctggcttcgtttcttctggaacatattttggtggcatttgatttctggagaacaaagggatccctacaaggtgatgcataaacatgcgtggcccagatggactgtgctcattggagacagggaaaacaaaaggcctttgattgtgcctcgttttctttggaagtgtgtcttgcttcagactaacagaatgcctttgctcctagaataaaatgtaatggaactgaaaattgaagaatctgggcctttttccctttcctaattatttccacttgactcacttaatcttggacgattattcagtcatatctgaaatgagaaaatgacgggagtaaaatttccatctcttgttacaagggcttataaacattaacagaataatcctgtac

SEQ ID NO: 417124 - DNA, 501 bp, Homo sapiens
aggaatattaatttggaaccaaattaacagccaaaatagaagacactgcttgtgaatgggagtgaaagtagctcagcaagatggagatagacacaaggatggcataagataataaataatactaatataatggtagataatgacaatacgtcatgctggtatggtgctttctatttctcacaggtcatttaagttcccctttgttcctcagaacattcctgcgtggtagatagggtgtgtattcctgatcttagagatgaggagactgaaatgagatctttaataactcacccaagatcatccaaacttagtagtggagtcaggatcattactacttgaactgtggcttcctaactgaaaaaaatacattgtacctgtgtttatcaattgttgtattccatgaagggtgctaagaactgtggcatgaagcattgatcacattggtttgaacggactacggttataaaagtcttattgatggaaataaacttattaattttt

SEQ ID NO: 417125 - DNA, 7826 bp, Homo sapiens
ccagcaccccggggctgcgcactgcagctccccaggccacccaccacccttctggtctctgagcccaggatgcgaggatggccagaccatctctgtgcaccctggctcgtctgggccctgagtgcttgcgccccttcacccgggagtcactggcagccatagaacagcgggcggtggaggaggaggcccggctgcagcggaataagcagatggagattgaggagcccgaacggaagccacgaagtgacttggaggctggcaagaacctacccatgatctacggagaccccccgccggaggtcatcggcatccccctggaggacctggatccctactacagcaataagaagaccttcatcgtactcaacaagggcaaggccatcttccgcttctccgccacacctgctctctacctgctgagccccttcagcgtagtcaggcgcggggccatcaaggtgctcatccatgcgctgttcagcatgttcatcatgatcaccatcttgaccaactgcgtattcatgaccatgagtgacccgcctccctggtccaagaatgtggagtacaccttcacagggatctacacctttgagtccctcatcaagatactggcccgaggcttctgtgtcgacgacttcacattcctccgggacccctggaactggctggacttcagtgtcatcatgatggcgtacctgacagagtttgtggacttgggcaacatctcagccctgaggaccttccgggtgctgcgggccctcaaaaccatcacggtcatcccagggctgaagacgatcgtgggggccctgatccagtcggtgaagaagctgtcggatgtgatgatcctcactgtcttctgcctgagcgtctttgcgctggtaggactgcagctcttcatgggaaacctgaggcagaagtgtgtgcgctggcccccgccgttcaacgacaccaacaccacgtggtacagcaatgacacgtggtacggcaatgacacatggtatggcaatgagatgtggtacggcaatgactcatggtatgccaacgacacgtggaacagccatgcaagctgggccaccaacgatacctttgattgggacgcctacatcagtgatgaagggaacttctacttcctggagggctccaacgatgccctgctctgtgggaacagcagtgatgctgggcactgccctaagggttatgagtgcatcaagaccgggcggaaccccaactatggctacaccagctatgacaccttcagctgggccttcttggctctcttccgcctcatgacacaggactattgggagaacctcttccagctgacccttcgagcagctggcaagacctacatgatcttcttcgtggtcatcatcttcctgggctctttctacctcatcaatctgatcctggccgtggtggccatggcatatgccgagcagaatgaggccaccctggccgaggataaggagaaagaggaggagtttcagcagatgcttgagaagttcaaaaagcaccaggaggagctggagaaggccaaggccgcccaagctctggaaggtggggaggcagatggggacccagcccatggcaaagactgcaatggcagcctggacacatcgcaaggggagaagggagccccgaggcagagcggcagcggagacagcggcatctccgacgccatggaagaactggaagaggcccaccaaaagtgcccaccatggtggtacaagtgcgcccacaaagtgctcatatgggactgctgcgccccgtggctgaagttcaagaacatcatccacctgatcgtcatggacccgttcgtggacctgggcatcaccatctgcatcgtgctcaacaccctcttcatggccatggaacattaccccatgacggagcactttgacaacgtgctcactgtgggcaacctggtcttcacaggcatcttcacagcagagatggttctgaagctgattgccatggacccctacgagtatttccagcagggttggaatatcttcgacagcatcatcgtcaccctcagcctggtagagctaggcctggccaacgtacagggactgtctgtgctacgctccttccgtctgctgcgggtcttcaagctggccaagtcgtggccaacgctgaacatgctcatcaagatcattggcaattcagtgggggcgctgggtaacctgacgctggtgctggctatcatcgtgttcatcttcgccgtggtgggcatgcagctgtttggcaagagctacaaggagtgcgtgtgcaagattgccttggactgcaacctgccgcgctggcacatgcatgatttcttccactccttcctcatcgtcttccgcatcctgtgcggggagtggatcgagaccatgtgggactgcatggaggtggccggccaagccatgtgcctcaccgtcttcctcatggtcatggtcatcggcaatcttgtggtcctgaacctgttcctggctctgctgctgagctccttcagcgccgacagtctggcagcctcggatgaggatggcgagatgaacaacctgcagattgccatcgggcgcatcaagttgggcatcggctttgccaaggccttcctcctggggctgctgcatggcaagatcctgagccccaaggacatcatgctcagcctcggggaggctgacggggccggggaggctggagaggcgggggagactgcccccgaggatgagaagaaggagccgcccgaggaggacctgaagaaggacaatcacatcctgaaccacatgggcctggctgacggccccccatccagcctcgagctggaccaccttaacttcatcaacaacccctacctgaccatacaggtgcccatcgcctccgaggagtccgacctggagatgcccaccgaggaggaaaccgacactttctcagagcctgaggatagcaagaagccgccgcagcctctctatgatgggaactcgtccgtctgcagcacagctgactacaagccccccgaggaggaccctgaggagcaggcagaggagaaccccgagggggagcagcctgaggagtgcttcactgaggcctgcgtgcagcgctggccctgcctctacgtggacatctcccagggccgtgggaagaagtggtggactctgcgcagggcctgcttcaagattgtcgagcacaactggttcgagaccttcattgtcttcatgatcctgctcagcagtggggctctggccttcgaggacatctacattgagcagcggcgagtcattcgcaccatcctagaatatgccgacaaggtcttcacctacatcttcatcatggagatgctgctcaaatgggtggcctacggctttaaggtgtacttcaccaacgcctggtgctggctcgacttcctcatcgtggatgtctccatcatcagcttggtggccaactggctgggctactcggagctgggacccatcaaatccctgcggacactgcgggccctgcgtcccctgagggcactgtcccgattcgagggcatgagggtggtggtgaacgccctcctaggcgccatcccctccatcatgaatgtgctgcttgtctgcctcatcttctggctgatcttcagcatcatgggtgtcaacctgtttgccggcaagttctactactgcatcaacaccaccacctctgagaggttcgacatctccgaggtcaacaacaagtctgagtgcgagagcctcatgcacacaggccaggtccgctggctcaatgtcaaggtcaactacgacaacgtgggtctgggctacctctccctcctgcaggtggccaccttcaagggttggatggacatcatgtatgcagccgtggactcccgggagaaggaggagcagccgcagtacgaggtgaacctctacatgtacctctactttgtcatcttcatcatctttggctccttcttcaccctcaacctcttcattggcgtcatcattgacaacttcaaccagcagaagaagaagttaggggggaaagacatctttatgacggaggaacagaagaaatactataacgccatgaagaagcttggctccaagaagcctcagaagccaattccccggccccagaacaagatccagggcatggtgtatgacctcgtgacgaagcaggccttcgacatcaccatcatgatcctcatctgcctcaacatggtcaccatgatggtggagacagacgaccagagccagctcaaggtggacatcctgtacaacatcaacatgatcttcatcatcatcttcacaggggagtgcgtgctcaagatgctcgccctgcgccagtactacttcaccgttggctggaacatctttgacttcgtggtcgtcatcctgtccattgtgggccttgccctctctgacctgatccagaagtacttcgtgtcacccacgctgttccgtgtgatccgcctggcgcggattgggcgtgtcctgcggctgatccgcggggccaagggcatccggacgctgctgttcgccctcatgatgtcgctgcctgccctcttcaacatcggcctcctcctcttcctggtcatgttcatctactccatcttcggcatgtccaactttgcctacgtcaagaaggagtcgggcatcgatgatatgttcaacttcgagaccttcggcaacagcatcatctgcctgttcgagatcaccacgtcggccggctgggacgggctcctcaaccccatcctcaacagcgggcccccagactgtgaccccaacctggagaacccgggcaccagtgtcaagggtgactgcggcaacccctccatcggcatctgcttcttctgcagctatatcatcatctccttcctcatcgtggtcaacatgtacatcgccatcatcctggagaacttcaatgtggccacagaggagagcagcgagccccttggtgaagatgactttgagatgttctacgagacatgggagaagttcgaccccgacgccacccagttcatcgcctacagccgcctctcagacttcgtggacaccctgcaggaaccgctgaggattgccaagcccaacaagatcaagctcatcacactggacttgcccatggtgccaggggacaagatccactgcctggacatcctctttgccctgaccaaagaggtcctgggtgactctggggaaatggacgccctcaagcagaccatggaggagaagttcatggcagccaacccctccaaggtgtcctacgagcccatcaccaccaccctcaagaggaagcacgaggaggtgtgcgccatcaagatccagagggcctaccgccggcacctgctacagcgctccatgaagcaggcatcctacatgtaccgccacagccacgacggcagcggggatgacgcccctgagaaggaggggctgcttgccaacaccatgagcaagatgtatggccacgagaatgggaacagcagctcgccaagcccggaggagaagggcgaggcaggggacgccggacccactatggggctgatgcccatcagcccctcagacactgcctggcctcccgcccctcccccagggcagactgtgcgcccaggtgtcaaggagtctcttgtctagcaggcagcatcggggtggccccactgagtctcggcatagtccccagagctcccccgtggtgcctgcacacagagtgagggaggagggctttgaatctgggactgtgcctggctccctgatgggggacaggatttggccacactggggctgacacccaggcccgagcgcctgcgttcccagaccatgggaaatgggaattgcgctcaggggctccatgctgggtctgaggcccctgcctccaagatttaacctgcaagttgctctgacctcctctgggccctgtcgcccctccttttggcctgggggaggtcagaacattcgaatctctgcccctcacttgaggaggagctggcctgcggtggagggatcagttgccccccatcaccagagtcttaagggtcactggcctctccccaggaagtgggctcagacccccctcagccccagcccagacaaagatgtcttaacctcagggagtgcagacacctaaccccagggcactgccagcccaccccctttgactctggggtgcagcttcacccaccaggccagctcaggaattccctggaaaagggaaatgtgactggttcagaaatagctcctcaaagcctcaaaacctgattggccactggatcctgctgctttgggctgggatggtgactcctgaaacctcttcctaggccacgtccaggtccgtagctcccctggctggctcctaggggaagagcagaaggaaggatgccacttgggaatgaattgtccttttctaggaagcacgggggagtgagacaggctgggtcctgccagctggatcgctgcacatggcctgagcatccagacctgagcgggagtcagggacctgctgctcagtaagaagattctcgccccttccctctctccctgcctcactcctccgtgagcaccaccagggctccaggagcctcatccagcctcagagatctcccttctcatctccccacgccccgtctctttctcacctttcccacctctctccccaaagtgatcctaagaatgtacagttgagctcaggttagatatttcgaccctggggcgtgcagcagggaaggcccaactggttcaggctcaaccttccaacttcctgtggcctgaagaagcacttctgctgcatcgctgttctgggcatggcagggccaggcctctgctggctcaggaggaggggtgagagacctgctcaggcgtcgctggatttattcacttgtgtgtgtacctgtggctgtgtgtctgcttgtatgcttttataggcctgtgtgtatagctgtgtgtgtgttcaagtgcgtgactgtatgtgtgtgtgtgaaccactgtgtgaaccactgtgtactggagcctgcattatgcacgtgtctgggtatctttgtatatatgtgtatatatgtgtgccctggactgtttcaaggtccatggagtacggctggtgtgtcatactgtgcaggcctgtccctgggagtgttcccgtgcctgggagagtggacctgtgctgtgagtgtgtggatgcgtgtgaacgcatgtggtaaggtgtgtactcagggcattctgttggcctaagtgcctcttctttttcttcttgtttctcatgaaaagtttgattaaaattcaggaagcagcaaaaccttcaaaacaagacatgtatgtgtgcttgagtgtgtgaacacgtgtgtgtgtgtgcacatctacatgccatgcctatgggccagagttgtctttattgtccaccatgctctctcacctgcttcccagtcctgcctgaacagccctctctctcactcccctctcctccccttcctgtttctcgttgtcacacccatggcctcagccctgctccctgcctcctgcctatgtctcctctatggaaggaggcctccactccttccatctcttccttcagaagtttcgtctaatgggggcagtctccccttcctggcacattgcccctctgccttgccctcctgggccctgggctggcacagcccctggagcctcagaaatctgtttgattggatattctcctcggactgtgtgcaggttgcagaggaagagtagatgagccgggtccggcctctccctgcctgtggcccctcccctgcagacggatgcccattcctgcctggtccagtggggaacaggtcccacgccaggccagcaggcgggctcctttgtacagttcttacaataaaccctccttggtgcctctggtat

SEQ ID NO: 417126 - DNA, 2421 bp, Homo sapiens
  misc_feature (278)..(278): n is a, c, g, or t
  misc_feature (328)..(328): n is a, c, g, or t
ctttcatcctggatcccaggaaatttggtccaggaaaattcaccggagtgtgcttacagctggtgttgtccaccgagccagctctcctctctggccccaggtttccctgccagaaattcccagcatctgtgttgtacatttgattttctagatgtggataacactgaggtgggtttagagatcccctaccctccattaaatgtcccttactctgtgacctgtgaatacaaaatgtttaacttaatcatagccttttgcaagtcagtcctagattactnaagaacaaataattttgcttaccgctccactgaaacacccagtgaccgcntaatagcagtctcaatttcacctcatttttttcctttcagctgcagagcttaccagtcatgtgtgattattatttttaaaatcatctcaaaattttagtatattttcagttatggaaccataattgtagtctaaatttatttattttaaaaaatgtaaatgcatctttaatagacaaataataattttgtacatttatgtatgaggcacagtgtgatgttttgatctaagtatgcatggtgtaaagatccagtcaagctaatgaacacatttgtcacctcaccaacttatcactttttggtggccactttttaaaacttcttcctgccacagttctctcctggttttcctttcaactacgtgacagtgacagttttctcaggccctgtttcccttcctagccagagccgtgttgcatttatctctatgcttccagcaaccagcacagaacctggtctgcatttgcttcagtaagcatttgtagggtgacaagatgatgaaatcatttaaatgtactcattctttacttgtgtgtttttttccctctttgaaacataattttaaaaaaatcttggtaccatccagaattaagtttaatattctctcttctggattgtgttatcactctaattattcatagttcccatttgataaaaataccatatacattataaatgttgacaaataattattaaacataaaattagaattttattgaaaaggcctctctcaaggatatgtatggacctttttttccacatagtttatgtatctatgaatgaaaactacttattcttagaatgacagagggttctacattaattcggtcctaactttctgttttttaactattttatattatagcaattttatatatttgctaatagagagattagtataatacaatcatcatttttcctctttttatggttgcctataaattgtactgtctagatgtatgtaaactatctagcctatgtaagtcttggattagtcaacttttattgagtgaatgatgtagacagctgtcctcacttgacttctttaattgttatacacaaaatttcagtcttatttttattagactgttggaatgttgactatatgattgtatgtatgaccacagtctatacatataggctgtatgacctcactccttcttggcggccatggcagatttactgatctatcagataattgttttctgtggagctcagaatccattttaacatggtgttccagacaactgtcacaaaccaaccagagtggttatgggagccaaaatcaattttatttttttaaaattgtatgaaaatctttttaaaaagaatgtcatctttgctatttttttcccaaatatggtacatgctaagaataaaaatcaagaaaccagcacagaatctggttctagtgaaaagttcacagaaaaaaagtaaaatctcatctaaaattcttcctcccggctgggtgcagtggctcacatctgtaatcctagcagtttgggaggctgaggcaggtggatcacctgaggtcaggagtttgagaccagccagaccaacatggaaaaaccccatctctactaaagatacaaaattagccaggcatggtggcacatgcctataatcccaactactagggaggctgaggcaggagaattgcttgaacccaggaggtggaggttgcagtgagctgagatcgtgccactgcactctagcctgggcaacaagagtgaaactctgtttcaaaaaaaaaaaattattcctccaagagattagcattgtgatttttatagagtattgttttgtacacctgtctttgaaaacacaaattaagctgagtacaaataattttataaagatgggattttttatatgcagatcatttaaattataacattttttcttgaattgaatggaaggaagaaacagaatgaattgctgaacctcagattgtgtctttacaagggaatgtcattctttaaaggtacctcaaaggctaagaaaaacagtaaaaacctgcacgttgggcacatgtacgttgtgcacatatacctaaagtgtaataaaaataaaataaaataaaattatcattagt

SEQ ID NO: 417127 - DNA, 241 bp, Homo sapiens
attctttgcttttaggaaatccagtataggaaaatctaaagttggaaaacagataaccctcaaggtgattatttatatgatcaaataattggttactttccaaaagtccctttcaatgaaaaaaaaaaaaaacaataaaaaactaaatcaaatccataaatataaactaagtacctaatcttatgagcaagaaagaggagaatgaatatacaaagaagaccaagattaatttggggtattt

SEQ ID NO: 417128 - DNA, 3650 bp, Homo sapiens
  misc_feature (153)..(153): n is a, c, g, or t
  misc_feature (169)..(169): n is a, c, g, or t
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtcccngagctccgcacagtgngccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttaaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtc

SEQ ID NO: 417129 - DNA, 3741 bp, Homo sapiens
  misc_feature (153)..(153): n is a, c, g, or t
  misc_feature (169)..(169): n is a, c, g, or t
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtcccngagctccgcacagtgngccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttaaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttaaaacctctctttccagtgttccctctctccctccagggccactgcttgaagaagaatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtcctcttgtctgttatctgagttttcaaaagctttaagactctgggaacatctgattttatggattttttaaaaataaaaaatgtacattata

SEQ ID NO: 417130 - DNA, 3594 bp, Homo sapiens
  misc_feature (153)..(153): n is a, c, g, or t
  misc_feature (169)..(169): n is a, c, g, or t
gcgctcggcgcccaccaggcggacgcccaggagaacccctgcctccgtcgcggctcctggagagctgatcgttcacctgccccggcccgcctgaggacgggggtgccttcatgcggcccccacactcctcaccccgccgccgccgccgtcccngagctccgcacagtgngccccagccccagcagggcgcacaactttggaagtctcgcggcgctccgagaggcggcagagtccgcgccccagccccgggccgggccgggccagaaccgcagcgtctgggggaagccagagagtcggtaatcgcttcggggatgtaaggcgacagacataggacccccgagctcgcatcagcacccttcggctgcctcccggggtgggggcgggccccgcacacggtaagacctcttgctttcgctcaggctcaagattcaagatacagatattgatatgtatatatatatttaatttcctgtcatccttccaagttatcaggccaccgatgatttttgttctcccttcttgaagaataaatctctctttacccatcggctctccctactctctcccgccgcttagaaataaaacttggctgtattaggagctcggagcaagaaggcgcccaccgagagcgtctgaagcgcgagccaggcgcagttcgcgggacccgggccatgggccgctagcggtcctccagttcgggcccggcctccctgcggccccctccctatgtgagccgcagccaggcgagcggggcgccggaggaagaggaggacccacgggcgccgggccggaaggcagctggcagcaggcccaggccagcgggcgcccgcgttcatgttccgccaggagcagccgttggccgagggcagctttgcgcccatgggctccctgcagccggacgcgggcaacgcgagctggaacgggaccgaggcgccggggggcggcgcccgggccaccccttactccctgcaggtgacgctgacgctggtgtgcctggccggcctgctcatgctgctcaccgtgttcggcaacgtgctcgtcatcatcgccgtgttcacgagccgcgcgctcaaggcgccccaaaacctcttcctggtgtctctggcctcggccgacatcctggtggccacgctcgtcatccctttctcgctggccaacgaggtcatgggctactggtacttcggcaaggcttggtgcgagatctacctggcgctcgacgtgctcttctgcacgtcgtccatcgtgcacctgtgcgccatcagcctggaccgctactggtccatcacacaggccatcgagtacaacctgaagcgcacgccgcgccgcatcaaggccatcatcatcaccgtgtgggtcatctcggccgtcatctccttcccgccgctcatctccatcgagaagaagggcggcggcggcggcccgcagccggccgagccgcgctgcgagatcaacgaccagaagtggtacgtcatctcgtcgtgcatcggctccttcttcgctccctgcctcatcatgatcctggtctacgtgcgcatctaccagatcgccaagcgtcgcacccgcgtgccacccagccgccggggtccggacgccgtcgccgcgccgccggggggcaccgagcgcaggcccaacggtctgggccccgagcgcagcgcgggcccggggggcgcagaggccgaaccgctgcccacccagctcaacggcgcccctggcgagcccgcgccggccgggccgcgcgacaccgacgcgctggacctggaggagagctcgtcttccgaccacgccgagcggcctccagggccccgcagacccgagcgcggtccccggggcaaaggcaaggcccgagcgagccaggtgaagccgggcgacagcctgccgcggcgcgggccgggggcgacggggatcgggacgccggctgcagggccgggggaggagcgcgtcggggctgccaaggcgtcgcgctggcgcgggcggcagaaccgcgagaagcgcttcacgttcgtgctggccgtggtcatcggagtgttcgtggtgtgctggttccccttcttcttcacctacacgctcacggccgtcgggtgctccgtgccacgcacgctcttcaaattcttcttctggttcggctactgcaacagctcgttgaacccggtcatctacaccatcttcaaccacgatttccgccgcgccttcaagaagatcctctgtcggggggacaggaagcggatcgtgtgaggtttccgctggcgcccgcgtagactcacgctgactgcaggcagcggggggcatcgaggggtgcttagccccagggcactcagaaacccgggcgctgcctgctctgcgtttcctcgtctggggtggctctgcagcctcctgcgggcgggcgtctgctgctcctacaagggaagcttcttgctgccaggcccacacatccccagttgttggtttggccactcttgacctggagccatcttcctagtgggccacccctaatcactattgcttcctaaaggtattttcaccctcttcgcctggtacagccctcacagctcttcagagcaagcactggactacaagggcatggctcacaaaaggttaatggatgggggttacctagccctggctaattccccttccattcccaactctctctctctttttaaagaaaaatgctaagggcagccctgcctgccctccccatcccccgctgtaaatatacactatttttgatagcacacatggggcccccatatctcttggccttggttttgatgttgaaatcctggccttgggagagatgccttccaggcagacacagctgtctggttcaggccaagcccctttgcaatgcaagccctttctggtgttatgaagtccctctatgtcgtcgttttcaccagcaactggtgactgtcccttcgacacggacctgctttgagatttcctgacagggaaaagatttctgtccatttttttcctgtgcctaacagcataattgccttttcctatgtaaatattatgatggtggatcaagacataagtaaatgagcctttctgcctcacatcagccctgtgtataaagccattattctctgatgcactgtttgccccagtaactcactttatatgtatgtttctatcttgtatgtctgtgtgcccctcctgccccgaaagtgctgactatggggaaatcttttagctgctgtttttagactccaaggagtggaaattatgtggaagaagcaaacctgatacaatttgcccaaggtaaacagtttgaaaagacaaatgggcctgccaaactgtacagtttcttccccaagagctgttaggtatcaaaatgttgtcctttcccccctccgtgcttttctggttgagatcatgtcattgatgaactgccaaagtcaggggaggagggcagagactttgtgtttacatctgcatttctacatgttttagacagagacaatttaaggcctgcactcttatttcactaaagaaaaactaatgtcagcacatgttgctaatgacagtggatttttttttaaataaaaaagtttacagatcaaatgtgaaataaatatgaatggagtggtc

SEQ ID NO: 417131 - DNA, 3756 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417132 - DNA, 3629 bp, Homo sapiens
gttttctaaaatactttttgttttttcttttcagatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417133 - DNA, 4226 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcggtgagtgctgctccttccgggctcgggcggcgtggggcgggtggggacgcgagggcccgcgggggcccacttccctgatgtggcggccgaacgaggaaggacggggcctgaggcccttcggccaagggtcgagggtcgccgggggctctctgctttctactctcgccaaggttttattggattcggaagccccaacttcgagacttgcagtcaaagcgatttttaaaatgacttgttttcaagcctctggccgccgcccactcttctggcccttggactttgaccaagatgttttctcgcagtttttgcaaggttttaaacttagccctcggcgttcttttaatgtaatacattgaaacgaagatatttcggtggcggcgatatttcatatttcatagttgccactgcgctctgtcattccagtagtcgtctgttgtgtattgtgagaagcaactctgggaaattattggatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417134 - DNA, 3702 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417135 - DNA, 3850 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtaagaagcaaataactatacattttatcattttattttaatttacatattagaacatacgtgttttcaatatttagtcttttttttcctgaaggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417136 - DNA, 1486 bp, Homo sapiens
ctataatgtctggccctctattgaacaagcactgagctgagtgggttatatgtgggtcgcagatatgtcctgcttgtgtgatgtgctaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417137 - DNA, 1504 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417138 - DNA, 3484 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcggattggcgaccatttcaaccaatagacctggccgtacgcctaaccactaacattactgcagcacacctactcatgcacctaattggaagcgccaccctagcaatatcaaccattaaccttccctctacacttatcatcttcacaattctaattctactgactatccttgaaatgtccccat

SEQ ID NO: 417139 - DNA, 971 bp, Homo sapiens
cgactcagccattattcggagaggaacatatgggctctcttcacccaatcgacatgtgagctctctatcgtgaatgggaccttagacgtctttgcatttacttgacagaagcatgatgttgttgcacaacctcggccatacctttgcctgcagagagaactgagggttccttatgggccatcggatatgctgtgtttctcatttttactgactgggtacttgactttgactgtacatggtctcataactgattactggacacgagtataaggactctccgacagaagatggttcatgtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417140 - DNA, 1111 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcggtgagtgctgctccttccgggctcgggcggcgtggggcgggtggggacgcgagggcccgcgggggcccacttccctgatgtggcggccgaacgaggaaggacggggcctgaggcccttcggccaagggtcgagggtcgccgggggctctctgctttctactctcgccaaggttttattggattcggaagccccaacttcgagacttgcagtcaaagcgatttttaaaatgacttgttttcaagcctctggccgccgcccactcttctggcccttggactttgaccaagatgttttctcgcagtttttgcaaggttttaaacttagccctcggcgttcttttaatgtaatacattgaaacgaagatatttcggtggcggcgatatttcatatttcatagttgccactgcgctctgtcattccagtagtcgtctgttgtgtattgtgagaagcaactctgggaaattattgggtaaatcccatagtttctattcttttcccttccatcctatcccctgcccagctgcaatttgcgtaaagagaatgcagcagtgcggtgcacgtagataaaaatctttcatttaaagataggatataagaccgggtgtaattaaagcaatcatgccagtggtcgtagtgccggagccactgtttcacaggccactgtgttaggttttgttttcgagttgctttctgtggtcgttgctttgaaattgtaagggaatggcagagtttaagagtttatattaatgaactcgtggtgcattttactgcagttttcctagtcgtggagagacttgatattacaaactaacgttgctgtcttaattcctgctgtactgctgctgacagggtgtagtggagtgtctgtctgtctttttaaccaatgtgcctttgcctccagcagagtgccagagttacctttaggccagaaaaggggaggagagcaagg

SEQ ID NO: 417141 - DNA, 3703 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaatttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417142 - DNA, 3702 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417143 - DNA, 3702 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaacacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417144 - DNA, 1497 bp, Homo sapiens
ttgttcctgttagatatgtatgtgttctgggttgtgacgtaaaatgtttttactatggagtacaatgaaagatttgaaagccatttttctagaatgatcaggttatatttgatatgaaacaattttaaaaaataattttcctcatatgttttaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttta

SEQ ID NO: 417145 - DNA, 2954 bp, Homo sapiens
agcgggtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtaagaagcaaataactatacattttatcattttattttaatttacatattagaacatacgtgttttcaatatttagtcttttttttcctgaaggtcgcaatgatgatgtcaaatgcttttgttgtgatggtggcttgaggtgttgggaatctggagatgatccatgggtagaacatgccaagtggtttccaaggtaattgttttgaaaaaggtatttgtacaaaaaactctgtgcttaaaagaagtaggcatgcctacatgattttgtttacctttaaattataacaaagcctcttttatgccattggggaattatccttctaaaagatcacattttaactttaattattttgttgaaaaatattctgcagtcttctgtgtacttttgtaagtcagttacaagtatgaccgtacattttatttatttcccatttcttttaaagagtacttaaggattacaggcgtgagccaccgcgtccagcccttgtttgtttttttgaggtggagtctcactcccagcctgggcgacagagaaagaccccatctcaaaacaacaggaaaaacaacaaaaccgggtgggcgtgccttcccatcggacacccgactcgcaagactgtcattcaaagtctcactctcgtgc

SEQ ID NO: 417146 - DNA, 547 bp, Homo sapiens
tcaggaagaccagatgttattccaaggggctgaaagttgtctacataacaggctcaattcatataatgaaatgaagagctgctagcagttgcctgatttatttagttggtaatatttgcagttacttcacacacacaaacatacacacgcgcacaaataggtatatataacatgtattaagaacaaatggtaaataatatatatgtatattttttaaaatttatatttttggtttaggaattaaggttttaaattgaatgctggttttagaaatgcatatcctgagctgtgtttttctctttcctggtttgctgtttattttttattttcacattctatatttttgtttagcctgtgagaggctaaagttttctttgatcatatcactcaatgtggccattaatatttctggagaagacacaaacctatttataatactttttaaaaatccgaagtgataataagaatgtttttacattgaaagtaatacttaagtgtttacataacattctgtatgcactcaagaaaataaagttttgttaataca

SEQ ID NO: 417147 - DNA, 488 bp, Homo sapiens
tctgcttaccttgtttccttttaattgataagctccaagtagttgctaattttttgacaactttaaatgagtttcattcacttcttttacttaatgttttaagtatagtaccaataatttcattaacctgttctcaagtggtttagctaccattctgccatttttaatttttatttaattttatttgcttgagcacactgatcaaccactgaactgccttcttccattgtcctgcaatgatataagggttacatttttgtgtatatggctttcatagttgggatttcagagcactgataccagatattttcagtttgttctctgggggaatttcatttgcatctatgtttttagctatctgtgataacttgttaaatattaaaaagatattttgcttctattggaacatttgtatactcgcaactatatttctgtaaacagctgcagtcaaaaataaaacactgaaagttttcattttgcagtggata

SEQ ID NO: 417148 - DNA, 2031 bp, Homo sapiens
ttagtagaggtggggtttcatcatgttagccaggatggtctcgatctgctgacctcgtgatcagcccacctcggcctcccaaagtgctgggattacaggtgtgagccactgtgccctgctgggaacaacgtttttaaccaactttgcctaagcagacaacagagttgagacattctggtagagaaataatagcccacatttgttgaattgtttttagctctttagttataaagagctttttacaaattaatttatgtaatcctccaacagtacaatgagatagataattttaattttacagactcaaactgcagaatggaaagtttaagtaacttaatgtcaaacagctaataagagatcaagataataatctaggctctttacctatctcctgggcataagcactagcttttttagtgtaaacagaatcaaattgttcattagatttggttgatgaaaagaggtctaccaaccatcatgtaaaataatggcatttatgtttatattcagaagactattatacattaatttggtaatacgtattttttgaggaaaggtataatggccatatgtatcttaaccagatacatccttaagcctacaatatgagtaaaagaaaattactcattttcttttgtggagtagaagttggatgggttatatgggcgtgatgcctctctcctgtaattccagcacttggggaggccaaggcgggcagatctcttgagcccaggagttctagagcagcctgggtaacatggcgaaaccccttctctacaaaaaaaagtagccaggcgtggtggcatgcgcctatagtcccagcttacacgggaggctgaggtaggaggattgctttgagcctgggaggtagaggttgcagtgagtcgagattgcaccaccgcactccagcgtgagcagcagagtgagaccttgtcttaaaaaaagttggatgggtagaggagggacattttgctagggcagactaacatctaggaagtggttgaagttattttttttaaaaaaggaagaaaagaaaggaattagtatttattgatcacacctttctgtatgttaggtggtttaggtttgttgtctttaaatcttccatatgatgatgataccctgttttacagttgagacccaagactatagatatgttaaataatttgcttgtggtcatacatgttctatcttctgaatagaagataactcctggaactgatagagagagggcagaaaaaagattctattttgagaaatggagcaacctgaaggcacatagctttgctgtttgctgtaactcctttagacagctctctgaccacacagtacgtgggtggacaccagcattgaccaggagggatggtgggaagtttaaatagttttcctttactgtaataaacactctagagaagtgaactattaaaggtttttccccatcaaatggctaaattaaacatttttgacattcgaaagggatgatttatatcttatgtggaaaagccccaaacaactatttccccagttgctggaaaaggagctcttttgagttatgaaggtattttatgttctttctccattattcttaacttgtgcttacaggtgaattgtaagcatgtgctttgtgtttagtattttcctcaagaaaactcttgctggtaaatctagttaccatagaacttgaaaggatattgaaagaatagttgaggactatcctgattggttttcatctacttagtctgtatttgtgtcatttcagtgtctgagtaggtggtttgtgattaacatttcacatgttatttttattgatttggcaagtaccagaaaacttgaaggatgaactagaggttatttttcttagcatttgtggtattagtactaaaaggggagtaagagagtagaaagaattctggacaactgttaagaattgttacattttgtctacctaggctcgagttcctcacttttaaaattaggactgtactttttggaagaatattgcttgttgtctttgctggtgggaccaggctg

SEQ ID NO: 417149 - DNA, 559 bp, Homo sapiens
acatggtgtgtgtaggaggctcagtgagagtgaaggctttgctttggtatgtagtgaagaataagattgactacactggctggagctagcttttgaagagtcaaatccaggcagcatttagatcaggggttatagcccagcagcccatgggccacatctggtctgcagatgtatatagtttggcccacagaatgactaaaaacttgggctccaaatcaggagattgtacaagcagtatcagatattctggattactcagaatctggattactgagtggtggaatatctgatactacttgtccaacatttctacagggcatcaatgaactagggctgagatagtagctgccttgttagatgaggcatggctatccagtgcgctacagtttccacaactgcttgtataatagtttccctgacactcaaatcatttaccacttaccagctgaggtcacttgccctttatcaggacacttgcactgttgttttcctattctaattaggtatttctctgtgcccatgtccctatcaatagtagggaagatagaccaaaaaaaaa

SEQ ID NO: 417150 - DNA, 413 bp, Homo sapiens
tgccaggaattcgggcacgagctctctctctctctctctctctctctctctctctctctctctctctctggatttttcccacaagaaactttgcagggcaatttcaaggtatgtcaaggaaatacattttggggtaaaacattttgaatttttcccttgttatgccagagtcagattggaaagtaagtcacaatacacaacgttaaataaaatccatctgatgagaatttatggtttgtagggcatgacaccccagactccttagaaaggagtttgggcgagataaaaaaaaatcagagcttagtcctcagtgcccccgcttggccaaaaagcattccatagaatgcatgtgcaggccaacaacagcagcaggtccctcggcgctaggaaggctcattcctagggttgtctga

SEQ ID NO: 417151 - DNA, 1126 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417152 - DNA, 1179 bp, Homo sapiens
gattcaccctaggcctcgctgatctctgtacaacgggggccagagctcttctgaggaaggcaggcttccctttgtacctgcactgacttttttctccttttggagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417153 - DNA, 646 bp, Homo sapiens
ctcctcccagttgcgattgacaaaaaaaaaaacctttgggggacagaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417154 - DNA, 1160 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417155 - DNA, 1380 bp, Homo sapiens
gattcaccctaggcctcgctgatctctgtacaacgggggccagagctcttctgaggaaggcaggcttccctttgtacctgcactgacttttttctccttttggagggagagcagagaccatgtctgacatagaagaggtggtggaagagtacgaggaggaggagcaggaagaagcagctgttgagtggggtcctctcccgccgctgccctgacacctggtccaggagcctcccagctgtccctcggattctgggtagaagtggagcaggaaggtaagcgtaaacgtgtgtactcatttggatcaaagacagcctggttcgaaactgacccacctcttctctcttctcttgctgcctggacttctgagcagaagcagctgttgaagagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417156 - DNA, 1105 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417157 - DNA, 1086 bp, Homo sapiens
ccccatgacagccgcagcctgctccccacctgcaaacttcagccccttctgggcctcgtccgcgcccccaggatctgtcggcagctgctgttctgagggagagcagagaccatgtctgacatagaagaggtggtggaagagtacgaggaggaggagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417158 - DNA, 1203 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagcaggaagaagcagctgttgagtggggtcctctcccgccgctgccctgacacctggtccaggagcctcccagctgtccctcggattctgggtagaagtagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417159 - DNA, 1470 bp, Homo sapiens
  misc_feature (1)..(1): n is a, c, g, or t
  misc_feature (4)..(4): n is a, c, g, or t
  misc_feature (1357)..(1357): n is a, c, g, or t
ngcngagactgagcagacgcctccaggatctgtcggcagctgctgttctgagggagagcagagaccatgtctgacatagaagaggtggtggaagagtacgaggaggaggagagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactgaaaaaaaagaaacagtagaaaactacatagaaaaaaattttggtggggcgcccaggccccgtaaaaaacttctatgacaccatccgtgggaggccggggcgacagcaggcacaggcagacgtgggccaagccgggtcaccaaaagacaacagcctgggtgatcaacatcggggggggcattctccccccattgtaggnagcggcgggggcgcaagcacgagccgtctcgcacaatgtcccaagtgagtgccaggacggcccagacggggaatcctagcaacgggagtgcaccgggtccgatgaaaatagcg

SEQ ID NO: 417160 - DNA, 1021 bp, Homo sapiens
cccccagcacagccacctcgtgcttctccttgagcatctcatagttggggggctggccactgttgacaggagagaagaaggtttggacagtgtgattcatggtgtccagcgaagaccaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417161 - DNA, 799 bp, Homo sapiens
gtgttagatcgagcgagaaggaggagctcgttgctctcaaagacaggatcgagagacgtcgggcagagcgggccgagcagcagcgcatccggaatgagcgggagaaggagcggcagaaccgcctggctacttcgtgggaaccgaaggccccgtagctctctgcctgtgcagctgctgaaggcatttccagagcaacaggaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417162 - DNA, 850 bp, Homo sapiens
ggcactcccagcttaaggggatgacgagacctcacatttgggaatcaggacctcattcaatcacgcagtcatttctcagtcagtggactcctgtgggccagcactgtgctgggagctaccctctcagaaagctccttgctgagcggagagaaagctgaactcacccataaagaccacaagcttcagcccagaatcagggtttccaatcctttcccctaatttgctttcttcctccctgctgtaaatcaggaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417163 - DNA, 1107 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417164 - DNA, 1122 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417165 - DNA, 1032 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagcccccttcagctcctgcatctgcccctgctgcctggccttcagcagtgttccatgtccaccgcattgacgactgcttgctggaagtgtctgagagctcgctggggctgagcagagacactttcctggtgttccaaccctgggggtctccaacacg

SEQ ID NO: 417166 - DNA, 898 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctgaagagagggctcgacgagaggaggaggagaacaggaggaaggctgaggatgaggcccggaagaagaaggctttgtccaacatgatgcattttgggggttacatccagagaagccagacagagcggaaaagtgggaagaggcagactgagcgggaaaagaagaagaagattctggctgagaggaggaaggtgctggccattgaccacctgaatgaagatcagctgaggagaacaggaggaagaggaggaggagctcgtttctctaaagacaagacccaggagaccagcagaagagattaagagaagaggagcaaggagcttagatgcccaattgagatc

SEQ ID NO: 417167 - DNA, 725 bp, Homo sapiens
  misc_feature (1)..(1): n is a, c, g, or t
  misc_feature (4)..(4): n is a, c, g, or t
ngcngagactgagcagacgcctccaggatctgtcggcagctgctgttctgagggagagcagagaccatgtctgacatagaagaggtggtggaagagtacgaggaggaggagcaggaagaagcagctgttgaagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtcgttcatgcccaacttggtgcctcccaagatccccgatggagagagagtggactttgatgacatccaccggaagcgcatggagaaggacctgaatgagttgcaggcgctgattgaggctcactttgagaacaggaagaaagaggaggaggagctcgtttctctcaaagacaggatcgagagacgtcgggcagagcgggccgagcagcagcgcatccggaatgagcgggagaaggagcggcagaaccgcctggctagaaaggctccacggaagagagagagacaagagaagctaggtgaggcccgaagagagctttttccacatgatgcatttgggttacaaccagaagcagccaacaaaccgaaaagtggaggagcaacttaccggaaagaagagaagttctgcttaaggagaagtcctgccattccaccttattagtcactaggagaagccag

SEQ ID NO: 417168 - DNA, 456 bp, Homo sapiens
attcgtgctggtgctaagggaagattctggctgagaggaggaaggtgctggccattgaccacctgaatgaagatcagctgagggagaaggccaaggagctgtggcagagcatctataacttggaggcagagaagttcgacctgcaggagaagttcaagcagcagaaatatgagatcaatgttctccgaaacaggatcaacgataaccagaaagtctccaagacccgcgggaaggctaaagtcaccgggcgctggaaatagagcctggcctccttcaccaaagatctgctcctcgctcgcacctgcctccggcctgcactcccccagttcccgggccctcctgggcaccccaggcagctcctgtttggaaatggggagctggcctaggtgggagccaccactcctgcctgcccccacacccactccacaccagtaataaaaagccaccacacactga

SEQ ID NO: 417169 - DNA, 856 bp, Homo sapiens
ccccatgacagccgcagcctgctccccacctgcaaacttcagccccttctgggcctcgtccgcgcccccaggatctgtcggcagctgctgttctgagggagagcagagaccatgtctgacatagaagaggtggtggaagagtacgaggaggaggagcaggaagaagcagctgttgaagaagaggaggactggagagaggacgaagacgagagcaggaggaggcagcggaagaggatgctgaagcagaggctgagaccgaggagaccagggcagaagaagatgaagaagaagaggaagcaaaggaggctgaagatggcccaatggaggagtccaaaccaaagcccaggtgagtggggaggcacctgggtagagccgggagcagaggctcagggagagaggatgatgatggaacagggtgcagtatggtgcagtggacacgggctgggggtttggtgggcacagagcaccacagtacagttgtacaagttgtgtactgcacaagcgtctcttcctaagggagtgagtgagggctgaattccacccaacactccatcaccaatcgtgcaccctagcagggatggggctatgttcttctagaggaagggccctgaacggacactctcctctctcacagtatggccagaacaccctcctccatggccgaggtgggaccttgggattaagggaagcaaattgtggggagccaaacaatgaaaccgtgccagcataggcatggcggcttcagagagctgagagagggcaggacggcttggtgccacacacgtgaagcccacctgaaggtggtgtgtgctggggggggctgggggatagggagcatttccctttttatgatgcc

SEQ ID NO: 417170 - DNA, 500 bp, Homo sapiens
ctggaggggaggagtgaagagattgggctggctggggaggggggaagctggtgagaggtgaaagagattagttaggcaaagaaggaagagactgacgtgatccttcttgcccctacctcagtttccctagggaatacatgtagttggtagttggggggtgtggcaggaagaagagcataagaacctggccctcctgcaggccttgctccacccccagggggtttggggagggttaggggacagggagggggcaatctggccagtttactctgcttcccacacccccagacagagcggaaaagtgggaagaggcagactgagcgggaaaagaagaagaagattctggctgagaggaggaaggtgctggccattgaccacctgaatgaagatcagctgaggtgggggctgggaggaatggtcctggggcactgcccgcatctgctctgggaggggtcgggccaagggcacttcttgctgtgagccaccagagggcaggactg

SEQ ID NO: 417171 - DNA, 1498 bp, Homo sapiens
  misc_feature (6)..(7): n is a, c, g, or t
  misc_feature (183)..(183): n is a, c, g, or t
  misc_feature (399)..(399): n is a, c, g, or t
  misc_feature (447)..(447): n is a, c, g, or t
  misc_feature (577)..(577): n is a, c, g, or t
agctcnncgactttactgtgccagatgtcatcccaagtccagaaaccatgtctcaggggaggaatctttttactgaaggggcatgaagaggggaaagaacactggccctgggtccagcattgtatcagctgcttcacatccagcatctaatgcagttgccccatctaatgctcaagctgtaangctaccttagtttctccaattaacagatgagagggccaaagctccaagtagttgggcaggttgcccaggatggatgcatacgtagaagatagaacaacccagagtggtgtgattccaaaccatgctttctccattgcatcacagtgatctttaagatcaccagcagagtggactgggacttcagggtaagatcacatcaagatatcaagtccaganaggccaaccccacaccgttcacatgatctctgaaacaattttcaagancagcactgtgaattcaactcgacactcttccatcaagcaaggacggaaaactccaaatgactgcaagacaagagctcccaggaaacacagaattccagagcagattcttcttttgaagtttctgtgaatnaaatctcataatcagagcttcactgcagcagataaatgggccagcgcctgagctcaaatgcacggaagcaaggaagacccaccccgcctgtctcccacctctctcggtgaaaccttcccagatggctgccagaaaggcttcagattcttggggaagcagtcaaatgtttcagcagccatttgacaagtctgtcatcctcctgcctctccctgactctcagatgatgtccatagagaatggagctgttgaggaagccagaaaggaactgaggaagtgacaaatagattcttgtataaaacaaaccaacaaaaattttatgggtgcattgaatgccaggagactcaaaaatagaagtgccttggatctctgtcaacctctaaggggtcccatgggagtgtgcctctcctccttcctctcaattgcattccccagcatctgtctcctgtgagagatgcttcccatctctggcattctactctacttcatcctgtgtgtgaccgccccagaactgtggaatggagttccaagacacagagaattggacaataagcagtgttgatgaggatgtacagcaacagagactctcatcttcctaagttcagtgggagcaaatgttggtaaaatcactttggaaaacagctactattaaaaaaaaaaaagtaccacaaaccagatggcttaaagcaacagaaatttgtgactcacagttctggaggccagaaattcaaaatcaaggtgtcagcagagtttcctggaggtgagagattcatatctgagctttccacctctaatgaggagcggcttcatgaaggaacggacgggattgctccagaaggtcattgattttcagcctctaaaaggacaactgtaatcctggttgatcttaactctcaaatttaataaaatcagtttaaatatttt

SEQ ID NO: 417172 - DNA, 317 bp, Homo sapiens
gtggaattagaagccaagagtgaaaccaagcaggaaaattactggcttattcagtatcaacggcttttgaaccagaagcctttgtccttgaagctgcaggaatgctcagtgatgaaatgagctgaagtcatccctccatgggggcatccactctaccattcaatggacacttattgagcacctgttgtggggcaccaatcactatgccagtccctgggactccagagatgagtgagacttggactcaaggagcttgcagttcaccagtggtggagaggtggaatggactcttgagcaggaatctataaaatgctgtg

SEQ ID NO: 417173 - DNA, 247 bp, Homo sapiens
aaataccctaagcgctaagaaaaccatgtgagagatgacagcacctgggtgttgcatgcaaatattaagaaaagatgcattggagagggcagggaggacatgttcacaggacctgtgccaacccctccctcagccgcaggcagcgcagcacacatcggaacaccctctgcatggggggaagagagggaagcgagtcccagattcaaccttggacctcagcactaccccagtaaaacccagtgcccag

SEQ ID NO: 417174 - DNA, 2485 bp, Homo sapiens
catgacttgagaagttaagtttactgttaattctaactacataactcacatttttgttgcctttatagtggaatctgattatgaagcatgcatcatttagagtcatcttgattgtggacaaaggaaacctaacccagagtggtttaagtgacaaagaggatttattggtcacacagtaggcaaattcagtctttaagcaagacttactcctggacttaaatggtgtgaccaggatctagtttctttctctctactctggctttattttctagtgcaggctctgttcacaagcaggctccatcctgtagtcccaagatggttgccccaggtccctggcccccttggactatggacatccagcagaaaagaggatgcttttctgcttaccatggcccggatatatcagtctcactggcgtgattgatcatgacttggatcatgtgcttctcccgctggtgttggagaatctcatgtgctgttaacttctaaacaggatgcaccccttagagtgaaagtttggtcagtctcaaccaaacaagttggctagaaagattggaatataacagaaaagaggaagaggagaatggatgttgggggtacagctaacaatgtactacagaaaaactattcagctgctttaggataatttgtctcttgagtggtgttgatttaaagatctttcttgagctggcctgaatgaatgattaatcagtcactctagaattggggcttcattatcattcattaacatggaactctatggagatcatgaccctggcttgtgctagtaaagtgatttgtattttaatctctcacctctttttcttgtattttcatttgagtctttaggccagtatgctagtgatggccagttacctttgatcttgagtcttactttctgattccaggctatgtattatctcctttctaaaggaccattttgtttgcaaactacagaacagttccttgttctttgcatgtggtctttcctacagtttgagaggagagcctccagctgtccttagtatccatcatttgtcttaacctttctaggatgtttacctaggtccctcagtaactgtagtcataataatagcaagcactcaatatagtacttatactgtgtgccaggcactgtgggaaatgccggcatatattaacagttaatcccataacaatcatatgagagagattattactgtctacattgtatagatgataaaacaggttccagagagattaagaagcttgcccaagggcttactgctgctaagtggctgaaggcatactaactctgcagtgtatactctttttcagtattcagtaaagtaaaaaaaaaaaaaagatgtaaagctcattggcagagagcattgctagtgaggtaattcaaacatgttaaaaagatctttggaattctcaggaatgcatcctgtggtctagaagaaaccagggcaaaatattgaaaaggaaagatgctgcttccaggttaaatgatactggatgggggggcaggaattgcattcagtgaatttacaagataccaggaaacccatctgttggaggaaggtaatgaaggagattatcttatcctacttattattttacttccttattctgtgggacagaagaatctcttgagtcctctaaaaaactatatgctgatagcaggagttacagaacaattcagtagtgtctggaatagaacagtggtttgaaaagtagagggcttgttaaagcacgggatgctgattcagtaggccttgagtggggataatttacatatccaacaggccaggtgatgccctggcttggggatcacattttgtgactgatgcagagtactgatggtcatccagtccccttccttcggtgtttgagaccacttcatctggaccgagctaaagtctaggaagaaataaagtttcaaacccagtagagttacctcaaagatacacttgagacccttttcagaagatggcaccgaaagtgaagaaggaagctcctggcccgcctaaagctgaagccaaagcaaaggctttaaaggccaagaaggtagtgttgaaaggtgtccacggccacaaaaaaaagaagatccgcatgtcacccaccttccagcggcccaagacactgagactctggaggccgcccagatatcctcggaagaccacccccaggagaaacaagcttgaccactatgctatcatcaagtttcctctgaccactgagtttgctatgaagaagataaaagacaacaacacccttgtgttcactgtggatgttaaagccaacaagcaccagatcaaacaggctgtgaagaagctctgtgacattgatggggccaaggtcaacaccctgatggagagatgaaggcatatgttccactggctcctgattatgatgctttggatgttgccaacaaaattgggatcatccaaactgagtccatctggctaattctaaatatacatatctcttttcaccaaaa

SEQ ID NO: 417175 - DNA, 279 bp, Homo sapiens
aaattggttataaaaaccttataccgccccccccctaagctgaaggtttcctttttaaattaaaatcgttttccactttttacacccccccccattacacctttttgggccccttttttttcccccaaaaaaaaaaaaaaaaaaaaaaaaaaaaaggtccacttgatgtgggagtggtgtggtaggctaaccacttgactttgaggaaagggagatatcttcctgtcccttataggggagtgatacagtgataggcccaacaggagggagtgctattgt

SEQ ID NO: 417176 - DNA, 1493 bp, Homo sapiens
tactactaaattcgcggccgcgtcgacccttagtatccatcatttgtcttaacctttctaggatgtttacctaggtccctcagtaactgtagtcataataatagcaagcactcaatatagtacttatactgtgtgccaggcactgtgggaaatgccggcatatattaacagttaatcccataacaatcatatgagagagattattactgtctacattgtatagatgataaaacaggttccagagagattaagaagcttgcccaagggcttactgctgctaagtggctgaaggcatactaactctgcagtgtatactctttttcagtattcagtaaagtaaaaaaaaaaaaaagatgtaaagctcattggcagagagcattgctagtgaggtaattcaaacatgttaaaaagatctttggaattctcaggaatgcatcctgtggtctagaagaaaccagggcaaaatattgaaaaggaaagatgctgcttccaggttaaatgatactggatgggggggcaggaattgcattcagtgaatttacaagataccaggaaacccatctgttggaggaaggtaatgaaggagattatcttatcctacttattattttacttccttattctgtgggacagaagaatctcttgagtcctctaaaaaactatatgctgatagcaggagttacagaacaattcagtagtgtctggaatagaacagtggtttgaaaagtagagggcttgttaaagcacgggatgctgattcagtaggccttgagtggggataatttacatatccaacaggccaggtgatgccctggcttggggatcacattttgtgactgatgcagagtactgatggtcatccagtccccttccttcggtgtttgagaccacttcatctggaccgagctaaagtctaggaagaaataaagtttcaaacccagtagagttacctcaaagatacacttgagacccttttcagaagatggcaccgaaagtgaagaaggaagctcctggcccgcctaaagctgaagccaaagcaaaggctttaaaggccaagaaggtagtgttgaaaggtgtccacggccacaaaaaaaagaagatccgcatgtcacccaccttccagcggcccaagacactgagactctggaggccgcccagatatcctcggaagaccacccccaggagaaacaagcttgaccactatgctatcatcaagtttcctctgaccactgagtttgctatgaagaagataaaagacaacaacacccttgtgttcactgtggatgttaaagccaacaagcaccagatcaaacaggctgtgaagaagctctgtgacattgatggggccaaggtcaacaccctgatggagagatgaaggcatatgttccactggctcctgattatgatgctttggatgttgccaacaaaattgggatcatccaaactgagtccatctggctaattctaaatatacatatctcttttcaccaaaa

SEQ ID NO: 417177 - DNA, 490 bp, Homo sapiens
tatgattttgttgtgctttttaaatataatctgacactctgctctttaattagggtgttcagaccacttacatttaatgtgattatttatacagttgggcttaaatctactatcttgctttttgatttctctgtctcatcagcccttttgtgtgtgtgtgtgtgtgtgtgtgtgtgttgtgtgtgtgtcagcctctatcttcaagtgattttataccatccttttctgctgtataagaccctattgtcattatacttgcatttctcccgtcgtagaatctgtatgattgttgtttatgttttacttccacataaagtataaatggcacaatattgttactattttttatttaaacaatatattatcttttaggctgggcgcaatggctcacacctataatcctagcactttgggagtccgaggaaggaggatcacttgagtccaggagtttgagaccagccttggcaacatagtgagaccctgtctctac

SEQ ID NO: 417178 - DNA, 2505 bp, Homo sapiens
gataaaactataaaattatggaaaataagtgaacgggataaaagagcagaaggttataacctgaaagacgaagatggaagacttcgagacccatttaggatcacggcgctacggatgacctgagaattaatttatggcacttagaaatcacagatagaagctttaacatcgtggacatcaagcctgctaacatggaggagctgaccgaagtcatcactgcagccgagttccacccgcaccagtgcaacgtgttcgtctacagcagtagcaaagggaccatccgcctgtgtgacatgcgctcctcggccctgtgcgacagacactccaagttttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggatagcgccatcatgaccgggtcctataacaacttcttcaggatgtttgatagagacacgcggagggatgtgaccctggaggcctcgagagagagcagcaaaccgcgcgccagcctcaaaccccggaagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaattttta

SEQ ID NO: 417179 - DNA, 970 bp, Homo sapiens
tcgggttgcaattcctccctgtacgaaaggacaagagaaataaggcctacttcacaaagcgccttcccccgtaaatgatatcatctcaacttagtattatacccacacccacccgatcgtgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccaattctcagccagtggctccttgtggagtcactgtggagttcaaggcaaaggtcttctctctcccactttgcatctagatgagtgcgtacggagtttggaac

SEQ ID NO: 417180 - DNA, 2105 bp, Homo sapiens
cagggtccagtacgcctggctgctgctgggctggcgcagagggacccactcttccccccgcctgccccaactccagacatcatgtgctccccgtttcggggatccagaagcttccagccagaggactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaattttta

SEQ ID NO: 417181 - DNA, 2141 bp, Homo sapiens
ccaggggctgtctggcctgggattattggatctgccgcccgcccgggcgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaattttta

SEQ ID NO: 417182 - DNA, 1405 bp, Homo sapiens
ccaggggctgtctggcctgggattattggatctgccgcccgcccgggcgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttcagctccaagggatccctcgaccttcttctttgggtatataacccttggggcgcacgatttctcgcggcaacggggtgtgggggcgacctccgggactccacgggctagatgttcccctggtcggggccgtccccgatggggggcccggttggctattccccacctttgtggtgggttgccgcgtctgc

SEQ ID NO: 417183 - DNA, 1222 bp, Homo sapiens
ccaggggctgtctggcctgggattattggatctgccgcccgcccgggcgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagggtcgaggggattcccgttggaggctgtaaagtctattccaacggtgaacatgagctggcagcctcccaggatgtagtcaattttaggagtagtctcggtttatcttgcaggatcgcaggatgatgatg

SEQ ID NO: 417184 - DNA, 1257 bp, Homo sapiens
cctcattttgtagacggaaaacaaggcctcccagtcatcttaggttgacctcctctccctaaagccctctgcctgggagaatggtgtccccagccttgttcctggaagtggctctggctttatttgcaggtgatcccagatctgcccacaaggaggccggggttggcctcctgatcactgccctagcagcagggtccatgaggagtcccataggggagcagtctctccactgtaccgctgtactgtaatgccacccccatactgctggctgggggcttaacccagcctcagcaagaactgcccatgctggtttgcacccagtggccctcacctctcttcccagcatcctctggggttgcctgcgatggttctactccttcctctggagcattcgcttcctaaggacaaaccctgggcatcggtcaccccttcatgcacaggtcggtgaccgagtacctccatgtgcctggcctgtggctggctgttcactagtgaaccatactgtcaggcccatttattcccgccaagaaggtgctcaggagatgtttgccggacacataggtgcttcccgcagacggagtcatcctaacccgttactcccaagcatctcaagtgctccaggtaacacttacacctaacctaaaggaaggcactgcgatcagggggaatttcaggcctggcctgggctgagatgagggatgccacttgcagacagccctggcccgcagccctaattttgtcctcaatggacacctgctgtagcagccctctgggcatagtgccgctcacaacttccggtcattaatccttattctctctcttccccaccccaccctcctccaccctgcaggcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaattttta

SEQ ID NO: 417185 - DNA, 292 bp, Homo sapiens
cactagagggtacagcctccatcagtggggcagacacactttctccttttcccagcaatcacagaagtcttcctgcaggaggcagttcaggagctatccaggccagctaggcagatgctgaggagaggcactacccaaacagaagacagagggtttgcttggggagttgagaggggctggagagcacctcttgggggacagctctggggtgaccgtgctgaacccaccccaggtcatgtgctacgactatgacaatgacgggggccatgacttcatcggcgagttccagacc

SEQ ID NO: 417186 - DNA, 2220 bp, Homo sapiens
ccaggggctgtctggcctgggattattggatctgccgcccgcccgggcgggaggaggaccggaccccgagcggctgggagcgcacgcgagcgggccgtggccgcgcgggcagcgccctgagcctgtcccgcgcccgcgggcccggccgagcaggagcagctcccggggatgcccgggcggctcggagcgcgggcagcggcagccgtgcggtgagggcggtggcgcccgcgggacctgcgactgccaggaactcctgccaccgccaccggctcccatggcccacatacccagtgggggtgccccagcagcgggggcagcccccatgggcccccagtattgcgtgtgcaaggtggagctgtcagtgagtggccagaacctactggaccgggatgttacctccaagtccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaattttta

SEQ ID NO: 417187 - DNA, 1930 bp, Homo sapiens
gctgcgatcctgcaagataaaccgagactactccttccttgactacatcctgggaggctgccagctcatgttcaccgttggaatagactttacagcctccaacgggaatcccctccgaccccttctgtgtcctctttacagagaacaatggcagatggatcgagtacgacaggacagaaaccgcgatcaacaacctcaaccccgccttctccaagaagttcgtgcttgactaccacttcgaggaggtacagaagctcaagttcgcgctctttgaccaggacaagtccagtatgcggctggacgagcatgacttcctgggccagttctcctgcagcctgggcacgatcgtctccagcaagaagatcactaggcctctgctgctgctgaatgacaagcctgcggggaagggcttgattacgatcgctgcccaggagctgtccgacaaccgcgtcatcacactaagcctggcgggcaggaggctggacaagaaggacctctttgggaagtcagacccctttctggagttttataagccaggagacgatggcaagtggatgctggtccacaggactgaggtgatcaagtacacactggaccctgtgtggaagccattcacagtgcccttggtgtccctgtgtgatggggacatggagaagcccatccaggtcatgtgctacgactatgacaatgacgggggccatgacttcatcggcgagttccagacctcagtgtcacagatgtgtgaggctcgagacagcgtcccgctggagttcgagtgcatcaaccccaagaagcagaggaagaagaagaactataaaaactcgggcatcatcatcctgcgatcctgcaagataaaccgagactactccttccttgactacatcctgggaggctgccagctcatgttcaccgttggaatagactttacagcctccaacgggaatcccctcgacccttcctctttgcactatatcaaccctatgggcaccaacgaatatctgtcggccatctgggctgttgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaattttta

SEQ ID NO: 417188 - DNA, 1031 bp, Homo sapiens
tcgggttgcaattcctccctgtacgaaaggacaagagaaataaggcctacttcacaaagcgccttcccccgtaaatgatatcatctcaacttagtattatacccacacccacccgatcgtgggcagatcattcaggactacgacagtgataagatgtttccagctctgggattcggggcccagttacccccagactggaaggtctcccatgagtttgccatcaacttcaaccccaccaaccccttctgctcaggtgtggatggtattgcccaggcgtactcagcttgcctgccccacatccgcttctacggtcctaccaatttctcccccatcgtcaaccacgtggcccggtttgcggcccaggccacacaacagcggacggccacgcagtacttcatcctcctcatcatcacggacggggtcatcagtgacatggaggagacacggcatgccgtggtgcaggcttccaagctgcccatgtccatcatcatcgtgggcgtgggcaatgcggacttcgctgccatggagttcctggatggggacagccgcatgctgcgctcccacacgggggaggaggcagcccgcgatattgtgcagttcgttccctttcgagagttccgcaacgcagcaaaagagaccttggccaaagctgtgctggcggagctgccccaacaagttgtgcagtatttcaagcataaaaacctgccccccaccaactcggagcccgcctgagctccagtgcccagcagcagcatgtcagctgagcctcctgccctcccccaggaacatgcacgctcactctgcttccttgtgggtggcctttttttaccgatccccttttttattttttacaaccggacctccacccccaacttcctccagcccagctgggcttcctttgttggagtcaactgttgatgcttccaggccaaactggcttcctctcctcctctccccacctttgccattcttaagtattgaatgtactttgtataattttagtggaattgttattgagaataaaattttta

SEQ ID NO: 417189 - DNA, 293 bp, Homo sapiens
  misc_feature (4)..(4): n is a, c, g, or t
  misc_feature (72)..(72): n is a, c, g, or t
  misc_feature (81)..(81): n is a, c, g, or t
  misc_feature (117)..(117): n is a, c, g, or t
  misc_feature (239)..(239): n is a, c, g, or t
  misc_feature (267)..(267): n is a, c, g, or t
gatntagtcttactaaagacgtgggaggaagttctccagctgagcagctttccccaacgtggaagggaccangcaaggacncctgagttctccaacagacgttcaacgccaggggantcacaggtgggtgcacctgtgtggaagtaaagctgttgcttattctgggagcccaatcctaggctgagggaggtgggcgcggggctgtttaagcgttggcggaggccgggctgggtcgctgngcgtctgctcctccttctcgcgcttctnctgccgccctaatcctgccttggcca

SEQ ID NO: 417190 - DNA, 3081 bp, Homo sapiens
tctgagttgcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgtcttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaaggct

SEQ ID NO: 417191 - DNA, 303 bp, Homo sapiens
gctgggattacaggcgtgagccaccatgcctgggctgccatttcatttccccttgtttatttccagggcctggactttgccggattcactgcacacatgttcattgggatttgtcttgttctcctggtctgctttccgctcctcagactcctttactggaacagaaagctttataacaaggaacccagtgagattgttgcatcaacaacagatctgcaacctgtgacacaataatgttaatgtggaaatataaaaaagaaccacattgcccagatcaggatgtcatttcagtcttttgtaact

SEQ ID NO: 417192 - DNA, 2919 bp, Homo sapiens
tctgagttgcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctgtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgtcttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaaggct

SEQ ID NO: 417193 - DNA, 2760 bp, Homo sapiens
tctgagttgcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgtcttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcagccaagactgaatgccactaatgggccattacctgaaggtaccgtgaagggcgagcttgtccttgggaaataaacctctggtgtgaattattccacttgcatctgaccagcgtcaacactgatggcctgtggagtggagcctaagctcagtccacagcagggcatgctgcatgatgcttggaagctggggggtgttgatttcaaagctgc

SEQ ID NO: 417194 - DNA, 1218 bp, Homo sapiens
tctgagttgcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctcccttgcagcactggcagcactggctgtgattggcgatggcccagcgtggttccatctgcacattcccctacctattccagacctacacacgcatgggttgtctgattctccttccttgtaactagttgtaagatcttactagttctctcattgataatgaattaaataaatttcttaac

SEQ ID NO: 417195 - DNA, 3153 bp, Homo sapiens
tctgagttgcttacttcgaaggctgtgctccgctcaccatccagagcggaggtgcggaccttaaactcactcctggagaaagatctgcaagtgcgcagagagaagactggcagtggagcatgcatctggagggcagagacggcaggcggtaccccggcgcgccggcggtggagctcctgcagacgtccgtgcccagcggactcgctgaacttgtggccggcaagcgcaggcttcctcggggagccggtggagctgacccctcgcactcctgccccaggggggctgccgggcagagctcttgggctcctgcaggccaggagtttgcttcattcctcacaaaagggaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgtcttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaaggct

SEQ ID NO: 417196 - DNA, 2905 bp, Homo sapiens
tctgagttgcttacttcgaaggctgtgctccgctcaccatccagagcggaggtgcggaccttaaactcactcctggagaaagatctgcaagtgcgcaggtctcactcttctttgccccagatgtccagctccaggtctaaagattcctgctttacagaaaacactcctttgctgaggaattccttacaggagaaagggtcacggtgcatacctgtttaccatccagagttcatcactgctgaagagtcttgggaagacagctctgctgactgggagcgaagatacctgctaagcagggaggtgtctggtctgtctgcatctgcctcctccgagaagggagaccttctggacagcccgcacatccgactccgtctttccaagctgaggcgctgtgtgcagtggctgaaagtcatgggcctgtttgcctttgtggtgctgtgttctattttgttcagcctatatccggatcaaggaaagctctggcagctgttggccttatcaccgctggagaactactccgtgaaccttagcagccacgtggactccacgctgctgcaggtggacctggcaggggccctagtggccagtgggccgagtcgtcctgggagggaagagcacatcgtggtggagctgacccaggctgacgctttgggctccaggtggcggcggccacagcaggtcactcacaactggacggtgtatttaaatccgaggagaagcgagcactcagtgatgagcaggacctttgaggtactgaccagagagacggtgtccatcagcatccgggcctccctgcagcagacccaggctgtccctcttttgatggctcatcagtacctccgcggaagtgtagaaacccaggtgaccatcgcgacggccatcctcgcgggcgtctacgcgctgatcatatttgagatcgtgcacagaactctggcggccatgctgggttcccttgcagcactggcagcactggctgtgattggcgatagacccagcctgacccatgtggtggagtggattgattttgagacgctggccctgctgtttggcatgatgatcttagtagccatattttcagaaacgggatttttcgattattgtgctgtaaaggcataccggctctcccggggacgggtgtgggccatgatcatcatgctctgtctcatcgcggccgtcctctctgccttcttggacaacgtcaccaccatgctcctcttcacgcctgtgaccataaggttgtgtgaggtgctcaaccttgatccaagacaagtcctgattgcagaagtgatcttcacaaacattggaggagctgccactgccatcggggaccctccaaatgtcattattgtttccaaccaagagctgaggaagatgggcctggactttgccggattcactgcacacatgttcattgggatttgtcttgttctcctggtctgctttccgctcctcagactcctttactggaacagaaagctttataacaaggaacccagtgagattgttgaactgaagcacgagattcacgtctggcgcctgactgctcagcgcatcagcccggccagccgcgaggagacagctgtgcgccgcctgctgctggggaaggtgctggcactggagcacctgctcgcccggaggctgcacaccttccacagacagatctcacaggaggacaaaaattgggagaccaatatccaagaactccaaaaaaagcataggatatctgacgggattctgctcgccaaatgcctgacagtgttgggatttgttatcttcatgtttttcctcaattcgtttgtccctggcattcatcttgatcttggatggattgctattctgggtgccatctggttgctaattttagctgatattcatgattttgagataattctacacagagtggaatgggcaacccttctgttttttgcagcgctctttgttctgatggaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaatagacatccatctattgctcgaagactaaaggaaacttcatccatcacaacccattagtcataaaactaccctgaccccactgtttgaagaagaaaaggtgcttaccctggagatgctacagagacacagtggaatagaccttgacactaacactctaattcaagcgaatgttggaacaccatgacctcctctgtgtgtcctttctccccaaggacaaaatgtagaaagatgtgagataacttactcaagattcccctccagaaaaatacgtatgtttaaaaacccttcctgctatacataggaaaagacacacatccacctaaaattgactgtactgtttaactgtcaattctcctgaggctaaacacagtttgtttttcttgtaatcacttttcatgttaaaataatcagcattcaaattgtatgctttctgaatatagactttctgggaaaaggtttactgctcgtaaggaaacattttatgtattaaaataaactgttccttgataaaaggct

SEQ ID NO: 417197 - DNA, 107 bp, Homo sapiens
taagctgagcagggcccagtactgagagggtcaagcctaggagaagaaaaaaagcagaaatggaaccagaatgacaacacttagtaatgtggataagatcatcacag

SEQ ID NO: 417198 - DNA, 1042 bp, Homo sapiens
tcaacaactactcggtggagagcgccgtggcggacgcgctaggagccgccggagtcactatgtaccgggatgcgatcctggcccagtggaatgacggcctgcacccagaccccatctacagcgcctccttcaccacacccaccaagcctttcagactccagtgctctggggcattcttcctgggtcttaccattatctgcatattgccaagcctgccattccaactcccttggaggtacaaatggcacagcctaattatggtttagaactagtaaccggcagtgcgaaaaatgggacttacttccgaattcatattaacaagtataaaatggtggaaaccatcacgtgcctttctagggagcccttccccgcctccaactacatccgcttgtttggccagcacgagcaactcctcaacaacctgtgtgctcggtacgatgaaaacctgatcacagatctctatagctacttcaccgagccgtggtgcctggccctgttccacgatcgttttattgatctcaggaaagagttacgccaaatcttagcctccaaggaggaggaagatcttccttccatagagcagttagcccatcaaatagaagatgaggaaatcaacccgactgagaagcccaggcaatacctcaaaagagtttttgaggaatccatctacaaaaccctggtggagagaagcactcttgactacctgcactataaccgctaccacctgcccatgtacgcgtggccaggcatcgtttagttgtaggcagggtctcccctttatggttttcatttatttagttcctggaaacgcgctctgtagaaatagaaaagttctctgcagcctggtttgacagcgaagccagcccctggtggttttgttcactcctttcctttcctgacttatgcctgtagttttctatcatcccagtaggtggcacacggccgtgtgcctctcttctggggcaggctcgctttacaaatcccaggcatgttcctgtgcagaataatccatttcagcaataaaatgagatcatactgtgta

SEQ ID NO: 417199 - DNA, 495 bp, Homo sapiens
ggggaggagaaaaacctgacaaaagtttggccagctaacacacagtaagaaattgacaattgtgaatgtgtgatcgagttttttcttttattagggctgaggaatagttgtttacctcttcagcagctgaagcatatttgagttgttgctagttttttgtgataatgaataaacctggtgtaaaatattccttacaggtttttgggtaaacacaagttttcacttcccttgtttaaatacctagggataggatggctagggcatgtggtgaatttacatttaccataacaaactgcttaactgttttccaaaatgcccataacattttgcatttccagtgatgatgcatgaaaattccagttgcatcctgtccattctctcactgctataaagaaatagcctgagactgagtaatttgtaaagaaaagaggtttaattggctgaccattccacaggctggccaggaagcatgattctggcatctgctcagcttct

SEQ ID NO: 417200 - DNA, 307 bp, Homo sapiens
aggagataagagagagatgtaagtgagaggaaggagaaattcatggaagaagttcaggaagaattcagaaggcatgcaaattgcacactgaatcactagtaagtaagtagttaagaataaggtaatatcagaaggaattaacctgaaggaggcggggagtagatgccttctagctctaagaaagaagatggatggtgattaaacatttccaagagtttgtggagtgttagaagctgagagaatgcaggcttgagatcctctcattattctttgaagccaatcaaattgtgagataaaaacctgagcc

SEQ ID NO: 417201 - DNA, 190 bp, Homo sapiens
gctcacctgcctgcctgcccaccactcacctcctgctgtgtggtctggttcctaaccggccatggattagtatgggtctgtggcctggggactggggacccctgtgctagactacttgaatctccagagctgtcaggaattctttagggtttgcagccaaccgcaggtcccaacggattgtgtttgggcc

SEQ ID NO: 417202 - DNA, 2062 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417203 - DNA, 2417 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggaaaaaaaaatattccacagggatctttgcatgatggtgtgtaaaaacttggttgaggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417204 - DNA, 886 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagtaggtgctgcctgcctgcctgaagctttgatttcccaaggcccatctccaagccttgacaagctcattcctgccaagctcataggcaggatgagcatgtggcatgcagaacagatcaataccgtctccaatgcattcatctcatagcatagatgatattagcaggagttactgttgatgcattaaaaatcaggcatactacagtgaaagcttcactgtcagcaacttttattgatgaacgtttcaacattttccagaaagtgtaccttgagacagaggctagcctcaagaaagaggcacccagggaacttccttttccccaaccccaagagtcaaaattacagatttagaaaaggctgcgggtaagtttggaagatgagaaaca

SEQ ID NO: 417205 - DNA, 910 bp, Homo sapiens
  misc_feature (834)..(834): n is a, c, g, or t
  misc_feature (847)..(848): n is a, c, g, or t
  misc_feature (864)..(864): n is a, c, g, or t
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggactttgcagacccctcagttccctgggattgagacagcacttcctgactgttaccttgggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggngttccacaaaccnnattgtgaggccaccangtgcacaaagatctggaaatggtaatgtgccccccgtgtttcttca

SEQ ID NO: 417206 - DNA, 549 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactcgatcgtgtcgaagaaggcatgaaccatatcaaccaagacatgaaggaggctgagaaaaatttaaaagatttagggaaatgctgtggccttttcatatgtccttgtaacaagtaggtactgggtaccagctctaatctgtggcgtccagttttctttct

SEQ ID NO: 417207 - DNA, 1130 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagaatgcatagcaaggaatcaaagatatgtggcatgaaatgctggctggtggatatgaggactaggaaaagtagagtaagggaatgcagattgaaaatgggattaatttgatgactgaatgctgatgagataactatggatgaagacatttgtaatcagataaccgtaaactgacaattaactgggaacgatggggcaagatgtaatttaacttactgaaaaaggaaacgtgcgggctaggatggaaaaacccttaatgatactgaatgcagtagaactaggcgaagcggaacgtgaaaattgaatctggggacttcgaaattatgctacccgacctatctctttgactgaatcgtaacaaaaatccttattattcatgggagatccaactacaccggccattaaaatctttatttataaacctctaattttatataatattttatgtcctttttaacggcgttaagcaatatagggaatctggtcaacaaacgtgaaagcccggcctttcttttggggcccatttgggtgggagttcaggtggaacgggcgtgggggcaatagtggcggccaattttggttgtttaaacaaagggatctaaactgaagtttcgcggcttcacaaactctttggtttttctggccagatcggttacggtcgtcgggcacctttgggctaacggagagctggggcgggaccttcttgttatcttcctccctttggacggcgggcggaatttcttttcctcttcaacggtaattttcgctctttttttttcgccggtttggggcaggccggctctttttttttcacttttagacgcctgttggaccggcgcg

SEQ ID NO: 417208 - DNA, 1132 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaacctggttgacccacgacgtacacacgatgctggtactcaccgcacttccgcgttactgctcggactgaccccccgcgacgaacaacctcgacctcgctgtcgcacacgaacggccctgacacccaactactcataccgcaacgcaacactgcacacgcgcaagcgcctgacagacacacacacctccacacccacgcactctccaccgcgacacactgcctgctgagcgcctctccccacctcctgctccctttgcctacacccacaccgacctctccccctcacacctgcactgccctctaacccccccaccacagcccctggcgcgccccccctcacctccacggacgcgcacgctgccctgcgcccacgccctaccccttgcctcggcctgctccccttgcgcactgcaccacgccgcgcacgcccccactcgcggcccccctccccctgcccccgcgcccttcccctccctgcccccccctcacacccaacaactggactcgcccccccgcacgcaaaacaactggacaaacttgggcacttccaacacacaccccttaaccacgcccacgcgctggcaccccgcgcccaacaccaacatcaggcgagacacaccccttcccccgactcccaacacaatggcgcccccccatgcggccttcatgggcgcccaaactgcacgcactcacggactcaccaaccagcaacacttccgcctccacatgcacttccgcacacgcgcaacatccactgggtaccaatccgggtctcggcagcctcccacacagccaaacacccccgtaaaca

SEQ ID NO: 417209 - DNA, 948 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgaggatgattaggtctgattgagtcgtctgcgcaaagacagccgccggtccgttcactgctgcaactgtggattggaccagaggagtcacaatgatgtctggataatcaagggatccttgggagtatgttaggtatggaacaaggaggaaccaacctcgagtcgatgctcagaatgaatggcactgagagccgattatcagaccaacgacagtgaagggacggcttgagaagacagttccaatacaggactttcatgggacacatgctcgttgagcctctattgatagtgctcctatgcttccgaagacttaagatcaatgtgatgcatctacaaacaacagtcgcttggggcaaactaattgctaggggaaccggtatgttgagtgagcctagcctagccgtgcgtcagtgttagctggacggaagcggggatgcctgactgggcccatccaaggcggccggcgttcatcccgaccagggatagacacggatgaatgccccgcagacaaatgaaagacaggcatgaaacacctagaagccagcgcgcagcggccatcgatcggggaaacccaccggtccaccatggccccctggacactacggggccaagtgagaatcagataaccaccagaaatcgccacaatcgagcccggatcca

SEQ ID NO: 417210 - DNA, 599 bp, Homo sapiens
taatgtcaaagtgaatgtctgaagttttgtctttttttctttgtccttttccatctgcttcattctgtggggataaaatacttgtgtttaatcagaaacaactggaacgcattgaggaagggatggaccaaatcaataaggacatgaaagaagcagaaaagaatttgacggacctaggaaaattctgcgggctttgtgtgtgtccctgtaacaagtaggtgctgcctgcctgcctgaagctttgatttcccaaggcccatctccaagccttgacaagctcattcctgccaagctcataggcaggatgagcatgtggcatgcagaacagatcaataccgtctccaatgcattcatctcatagcatagatgatattagcaggagttactgttgatgcattaaaaatcaggcatactacagtgaaagcttcactgtcagcaacttttattgatgaacgtttcaacattttccagaaagtgtaccttgagacagaggctagcctcaagaaagaggcacccagggaacttccttttccccaaccccaagagtcaaaattacagatttagaaaaggctgcgggtaagtttggaagatgagaaaca

SEQ ID NO: 417211 - DNA, 480 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccagttctggaaaggaagatgatacagaaaccacagccattttgcagatatgaaaactgggacatagaaatttgactgccctggaaaagatcacctacttatttgatgacagagccagttcagggatgaagatggagtcttgctctgtcacccaggctggagtacaatggcatggtcttggttccctgcaacctccacctcccaggttcaagcgattctcctgcctcagcctcatgagtagctgggattacaggcacgcgccaccaagcccaggtcactccagcagcacatgccaaaccaggatgagcaaagttcataagcttgctt

SEQ ID NO: 417212 - DNA, 2498 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactccaaaaaaaaaaccacaaatctcgatgactacatcaggggcggggcgcgccggtcatagaaaatctccctgagggagcgcagcaatattgtaggacacgcacccggcgttgtttgtttaacaaagggtgcgccccattggtcagagccgttgatattaatataagctaagaagcacggccggccgcttgtttataaacacacgtatcggtaggctagaaaaaaacagtgtatccttgagagcacctgctggtaaaagcacaccataactacgcgggggggacaaaacaactattggggacccaaactccccataaagaatttttaccgcccaggggagacatcattaacaacttcaccgtgtgtttatctgtcaaacaaggcagattattgctcgcgtgtaaagaaattaccttcacagggaagtttttggacactttc

SEQ ID NO: 417213 - DNA, 1908 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgattgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417214 - DNA, 1889 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgacccacaggtaccgaactcgagtcgtatcatgtcaactt

SEQ ID NO: 417215 - DNA, 1936 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgttgccacaaatgttgatgtagtgctgtaagaactttttaattaatgatgaattaacggagataattcttagctgtttctctgttct

SEQ ID NO: 417216 - DNA, 1868 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgtttcggtaacaactatacacaggggagagctatgatcgatgtgtatcaaatctagtgctcaaccatatggtactactattagcaacctgcccttgcgtggcaccttcgtgatgatgtacacacggtacacgagctgatgtatcatgt

SEQ ID NO: 417217 - DNA, 2062 bp, Homo sapiens
agtgggcttgggtaaatacaagtattggtgcacttagggtgcggtattccgtgtgtgcacgtctggtgggggctttataaagtgttttcgaggtgagctgctggggaaaagggaaacgggagccctgcaaatggagcgacggggaggaagagcgagggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417218 - DNA, 1959 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417219 - DNA, 1669 bp, Homo sapiens
  misc_feature (11)..(11): n is a, c, g, or t
atcagctcggnccaagttagtgggacgcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417220 - DNA, 1775 bp, Homo sapiens
taatgtcaaagtgaatgtctgaagttttgtctttttttctttgtccttttccatctgcttcattctgtggggataaaatacttgtgtttaatcagaaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417221 - DNA, 2360 bp, Homo sapiens
gagaatggtcaacttctggagtagtttggcttaaatgagaatgcttcactttctactcatgcctgtagctggtgcatgaagaagacgtagaggggtttccctttttggtgctagatggcttgttctctcttctcttttcctgcattcatttcactatgcttcttttactttttgtctctgtggacaaaggtttgtacatcaactctggatgtatggtgactgtttggaagtaccgatatattatctaattcaaatcactctagaggcaatgcaaagaccatcactcttggccaaccaccaatcctttatgtccttcatggagctttggaaatgttagttccacacgtgttgggatgttttcttgatgacagtgtgttgctgtggtgtgatgtgcacactctacttggcagtcttgttttgtgtctgtctgccagtatgtttttctctgttttatgtctccaaatataatcacatcactaaaatagaattaaatgtcctccagctaccttaatccttgtccaaaatccaaactaaaccacaaaacaaaccaaaacaagaacaaccttgtgggcaaagattgcagtccattgcaatggattcgattggaagtgaaatgttgagtagctgaggcatggtggtggccaactgtttgggtctggattatgatatatcggtattatctaatgcctcgacttaaaactcattcgcttggttcgattcttcgcttgaagaagtgacaattgttgagagcttgctcctccacccctgtgccttgtcactcaccctctcttttgcataggcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417222 - DNA, 1609 bp, Homo sapiens
agcggggtcatctttgatgagggcagagctcacgttgcattgaagacgaaacctcggggaggtcaggcgctgtctttccttccctccctgctcggcggctccaccacagttgcaacctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417223 - DNA, 1769 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417224 - DNA, 1355 bp, Homo sapiens
gatcccccgggctgcagaattcggcacgaggagagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417225 - DNA, 1312 bp, Homo sapiens
catgggacataatttcaccccaacatatattttgctggaaatgattaaatggtgagtgtgtccaatccatcttttttaaaattctttttttttaaaaaaggatgattatgatttagaagtctctatatattgacaggaaaaaagtgacactactgcacttttgctggtataacttaatccttgacagtgtctcaatactgagcatgctttgatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417226 - DNA, 674 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagaggtaagaagtgacagtattttaagataaaggaacaaatcccttatgctgatacatcctttcctagttgctatgatgtttccttgggccatgatcccctagattccagtgtggatgtagcctatcagaaaggcacagaatgagggagatgctgtatttaagttgccagatagccatgaagacaccttcaccctccttcccagcccaagccacctctgtagtctggtctgggaagcagagaataatagaatttccaagtctgtgctctcaagaaatcacagacgattgtatcactttaagcaaattagagcaattcttaatatacaaaggaattatctacata

SEQ ID NO: 417227 - DNA, 257 bp, Homo sapiens
actgatttctctttctctcttttctctctctaactccttttcaactttgctaccattattggaatgtagtaaagatgctggtatcaggactttggttatgttggatgaacaaggaggtaagttcagatttcttcagtaagaacaattcctcttctgaataatgtgcattttaaaattatttgtgcatacgcagatggtcgctttgacatgtgttacacatgtacacgaatgtgagggttctagatttttcatcttgc

SEQ ID NO: 417228 - DNA, 2004 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417229 - DNA, 1996 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaagtaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417230 - DNA, 2001 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagatcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagggtaacaaatgatgcccgagaaaatgaaatggatgaaaacctagagcaggtgagcggcatcatcgggaacctccgtcacatggccctggatatgggcaatgagatcgatacacagaatcgccagatcgacaggatcatggagaaggctgattccaacaaaaccagaattgatgaggccaaccaacgtgcaacaaagatgctgggaagtggttaagtgtgcccacccgtgttctcctccaaatgctgtcgggcaagatagctccttcatgcttttctcatggtattatctagtaggtctgcacacataacacacatcagtccacccccattgtgaatgttgtcctgtgtcatctgtcagcttcccaacaatactttgtgtcttttgttctctcttggtctctttctttccaaaggttgtacatagtggtcatttggtggctctaactccttgatgtcttgagtttcatttttcattttctctcctcggtggcatttgctgaataacaacaatttaggaatgctcaatgtgctgttgattctttcaatccacagtattgttcttgtaaaactgtgacattccacagagttactgccacggtcctttgagtgtcaggctctgaatctctcaaaatgtgccgtctttggttcctcatggctgttatctgtctttatgatttcatgattagacaatgtggaattacataacaggcattgcactaaaagtgatgtgatttatgcatttatgcatgagaactaaatagatttttagattcctacttaaacaaaaactttccatgacagtagcatactgatgagacaacacacacacacacaaaacaacagcaacaacaacagaacaacaacaaagcatgctcagtattgagacactgtcaagattaagttataccagcaaaagtgcagtagtgtcacttttttcctgtcaatatatagagacttctaaatcataatcatccttttttaaaaaaaagaattttaaaaaagatggatttgacacactcaccatttaatcatttccagcaaaatatatgtttggctgaaattatgtcaaatggatgtaatatagggtttgtttgctgcttttgatggctacgttttggagagagcaatcttgctgtgaaacagtgtggatgtaaattttataaggctgactcttactaaccaccatttcccctgtggtttgttatcagtacaattctttgttgcttaatctagagctatgcacaccaaattgctgagatgtttagtagctgataaagaaaccttttaaaaaaataatataaatgaatgaaatataaactgtgagataaatatcattatagcatgtaatattaaattcctcctgtctcctctgtcagtttgtgaagtgattgacattttgtagctagtttaaaattattaaaaattatagactcca

SEQ ID NO: 417231 - DNA, 661 bp, Homo sapiens
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagacgcagacatgcgcaatgagctggaggagatgcagcgaagggctgaccagttggctgatgagtcgctggaaagcacccgtcgtatgctgcaactggttgaagagagtaaagatgctggtatcaggactttggttatgttggatgaacaaggagaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggtcttattcgtcgagtttttttataaggtaactatttatttcttaaaaaattaaaaattg

SEQ ID NO: 417232 - DNA, 602 bp, Homo sapiens
  misc_feature (561)..(561): n is a, c, g, or t
agcggggtcatctttgatgagggcagagctcacgttgcattgaagacgaaacctcggggaggtcaggcgctgtctttccttccctccctgctcggcggctccaccacagttgcaacctgcagaggcccggagaacacaaccctcccgagaagcccaggtccagagccaaacccgtcactgaccccccagcccaggcgcccagccactccccaccgctaccatggccgaagaaacaactggaacgcattgaggaagggatggaccaaatcaataaggacatgaaagaagcagaaaagaatttgacggacctaggaaaattctgcgggctttgtgtgtgtccctgtaacaagcttaaatcaagtgatgcttacaaaaaagcctggggcaataatcaggacggagtggtggccagccagcctgctcgtgtagtggacgaacgggagcagatggccatcagtggcggcttcatccgcagtaacaaatgatgcccgagaaaatgaaatgggatgaaaacccgtcactggaccccccagcccaggcgcccagccacttccccaccgnttaccatggccgaagacggcagacatgcgcaatggagctgg

SEQ ID NO: 417233 - DNA, 2443 bp, Homo sapiens
atgactgacttgtagctggaagaaatcatcggatttttattcttttattaaagaaaaaaaatttgaaatgccttccatgtgccaagcactgtgtcaggtgggagatgacagcttggtgaaacctctgtcaggctgtcttcctccgctttctctatccctgggtttccccctgcctaaaaaggattttgtgcttcgtggcttgtccaggcaagcaggccgtcgcgggacctagaccgagacagtgagtctctctttctcccgggcctcccttctgtttcctgggctgcaggggagcaggaaatctggggcgagattcccgccgcggacgcgcactgccgaagcctggtccctcgacctgtccctgcccagcgcgggggcgcaaccgccacgcctcctcacccctccctccggctgcacgaataatgacaacagccgcccctcccacctttggcgtcacgttcaaaacaatcctttgactacaactcccagaaggccgagcggcttagcgagtgcacccgctctcggctgctccggcaaactacacatcccaaagggcagcgccgaccgcgtgtcctttcacagcgaaagtgcggaactgcgtttgtttccggcgtgggtccgggcaagaaccgcttgtagtttggtttaaattctgcacgggaggaccttctgagtttacctgttgggctcctggctgcgcaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaatatttttgccatatcataaaaaaaaaataa

SEQ ID NO: 417234 - DNA, 2393 bp, Homo sapiens
atgactgacttgtagctggaagaaatcatcggatttttattcttttattaaagaaaaaaaatttgaaatgccttccatgtgccaagcactgtgtcaggtgggagatgacagcttggtgaaacctctgtcaggctgtcttcctccgctttctctatccctgggtttccccctgcctaaaaaggattttgtgcttcgtggcttgtccaggcaagcaggccgtcgcgggacctagaccgagacagtgagtctctctttctcccgggcctcccttctgtttcctgggctgcaggggagcaggaaatctggggcgagattcccgccgcggacgcgcactgccgaagcctggtccctcgacctgtccctgcccagcgcgggggcgcaaccgccacgcctcctcacccctccctccggctgcacgaataatgacaacagccgcccctcccacctttggcgtcacgttcaaaacaatcctttgactacaactcccagaaggccgagcggcttagcgagtgcacccgctctcggctgctccggcaaactacacatcccaaagggcagcgccgaccgcgtgtcctttcacagcgaaagtgcggaactgcgtttgtttccggcgtgggtccgggcaagaaccgcttgtagtttggtttaaattctgcacgggaggaccttctgagtttacctgttgggctcctggctgcgcaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcagtgcgtttgggccgccgtcccacttatgtggagctggatgtgggccagggttctgtgtccatccctggtaccatgggggccctctacatcgagcggcctgcagatgtcgaagagggtttctctatccaggcccctctggtgtatcattttggttccaccactcctggcactaacatcaagctttataataagattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaactta

SEQ ID NO: 417235 - DNA, 2251 bp, Homo sapiens
atgactgacttgtagctggaagaaatcatcggatttttattcttttattaaagaaaaaaaatttgaaatgccttccatgtgccaagcactgtgtcaggtgggagatgacagcttggtgaaacctctgtcaggctgtcttcctccgctttctctatccctgggtttccccctgcctaaaaaggattttgtgcttcgtggcttgtccaggcaagcaggccgtcgcgggacctagaccgagacagtgagtctctctttctcccgggcctcccttctgtttcctgggctgcaggggagcaggaaatctggggcgagattcccgccgcggacgcgcactgccgaagcctggtccctcgacctgtccctgcccagcgcgggggcgcaaccgccacgcctcctcacccctccctccggctgcacgaataatgacaacagccgcccctcccacctttggcgtcacgttcaaaacaatcctttgactacaactcccagaaggccgagcggcttagcgagtgcacccgctctcggctgctccggcaaactacacatcccaaagggcagcgccgaccgcgtgtcctttcacagcgaaagtgcggaactgcgtttgtttccggcgtgggtccgggcaagaaccgcttgtagtttggtttaaattctgcacgggaggaccttctgagtttacctgttgggctcctggctgcgcaggcacagcagctacacagaagagatgggagaagaggctaatgatgacaagaagccaaccactaaatttgaactagagcgagaaacagaacttcgctttgaggtggaggcatctcagtcagttcagttggagttgttgactggcatggcagagatctttggcacagagctgacccgaaacaagaaattcacctttgatgctggtgccaaggtggctgttttcacttggcatggctgttctgtgcaactgagcggccgcactgaggtggcttatgtctccaaggacactcctatgttgctttacctcaacactcacacagccttggaacagatgcggaggcaagcggaaaaggaagaagagcgaggtccccgagtgatggtagtgggccccactgatgtgggcaagtctacagtgtgtcgccttctgctcaactacgcaattacatctcgtttagcagatgtgttcaaccaaaggtgtgaggtgaaccgaagggcatctgtgagtggctgtgtcattaacacctgtggctgggtcaagggctctggttaccaggctctggtgcatgcagcctcagcttttgaggtggatgtcgttgttgttctggatcaagaacgactgtacaatgaactgaaacgggacctcccccactttgtacgcactgtgctgctccctaaatctgggggtgtggtggagcgctccaaggacttccggcgggaatgtagggatgagcgtatccgtgagtatttttatggattccgaggctgtttctatccccatgccttcaatgtcaaattttcagatgtgaaaatctacaaagttggggcacccaccatcccagactcctgtttacctttgggcatgtctcaagaggataatcagctcaagctagtacctgtcactcctgggcgagatatggtgcaccacctactgagtgttagcactgccgagggtacagaggagaacctgtccgagacaagtgtagctggcttcattgtggtgaccagtgtggacctggagcatcaggtgtttactgttctgtctccagcccctcgcccactgcctaagaacttccttctcatcatggatatccggttcatggatctgaagtagagatcagcaggaagccttgctgcctgggacatagagatcatctggccacccctagaggcagatgggctgagataaaagactgttggggccacctgaccagtaaactgtggactagtagaaagttcatattctacctctaaaaacaggtagtggtaacctgactcttctaatcttgaaccaaaaggaaaaccatgagactgtaattggtttcttagaccacctaagatgccactttgaattctctaagaccctggagaattgcatttctttcactgtgctactatgtggtttttaaaaaatcaatgctttatattccatatgtggttcttacccatttatctaggatgaaagtgtgaattagagggactccttccaataaagttcaaacttaaaaaaaatcattttaataaatatttttgccatatcataaaaaaaaaataa

SEQ ID NO: 417236 - DNA, 373 bp, Homo sapiens
ggccacgtgcaacctgttcgctgtactaactgtgcccgatgcgtgcccaaggacaaggccattaagaaattcgtcattcgaaacatagtggaggccgtagcagtcagggacatttctgaagcaagcgtcttcgatgcctatgtgcttcccaagctgtatgtgaagctacattactgtgtgagttgtgcaattcacagcaaagtagtcaggaatcgatctcgtgaagcccgcaaggaccgaacacccccacccagatttagacctgcgggtgctgccccacgtcccccaccaaagcccatgtaaggagctgagttcttaaagactgaagacaggttattctctggagaaaaataaaatggaaattgtaaaaaaa

SEQ ID NO: 417237 - DNA, 725 bp, Homo sapiens
  misc_feature (457)..(457): n is a, c, g, or t
ctcatactcataatcagtattcaagtgataatgcatgatgttacaaatcagtgtctaaaaatctattaaagcaaattagagcaatggatttaatgtacatcggtattagatccacatgccaactaacctcttaaaactaccacttgttgaatttggtgtgaaaaaagaatattcacagtgatctgaaataatatttttaaatttctctgtgtttcaactatatatctttgtgaggccagattttcttcatttcttaaactaaaaaacatgttcaacagattgaatgcagaggcaggtatgagagtatagctatctaccattaaggcagacactgaagagttttgtaaaaaagtaaaacaatgctattctttttactaaatataattttattcagaaaattttagttcttttctgatgaactatttatgttaatatgactttattagttttaaaatgntacaatttttcttagttttaatttgcaatatgttaaatatcaatggagatactcccataaaaatgccatttggggtcctcaattatttttaagactcataaaggaatcctaagaccaaaagcttgaaactgctgctctcagtaaataggcaactgtgtatatccaaggttctaatagactctcactatgtataaacacaaaggcctacaactagatttttaaacatttttttttctaaattttgtttttttgtattttttatagaggg

SEQ ID NO: 417238 - DNA, 302 bp, Homo sapiens
tagttttaagcagaatatattctttattttaaaaactggtcatttgtatatctcatacatggcaattctattaaaaactatattgattaaccagaaaactctgcttcttggtcatggcaaataataaaaagtttactttccataaattcattttgcacctttctcttcagtctttgggggatatactatcctttaattatgcttcattcaatatgtgttttgcagattggttccagtatatcagtagcacttcgttactcaataataaaaagctacaaatagattaaaagactctcaagccc

SEQ ID NO: 417239 - DNA, 296 bp, Homo sapiens
tcaactcctcaaccaatatgtggtctaaaatcccagagtataagttcctgttttggctttgagttatctctgcttattatctggaggttaacctttctttccttaaagcttagacacgtattggaaaaaacttttattatattccacatttcagtttgttggtgtgggacagccattccacaggggcttattaccccactatgttacccaaagctcctcaatatagtttttaaaacaagtaaaccattgtattttagagtaatcttaggcatgccagacaaactgttgacaaccaa

SEQ ID NO: 417240 - DNA, 346 bp, Homo sapiens
catctctttaagaaaactcaataactggtaatagaggttgtcccaggggagggaaactatatggctgagggatactggtgggagggagatttttactgtatgcctttaaaacaaagttttaaataacattttaatctgtgctcctaagaaacaaaggaaaattcctatgtgccagagaaaactgaacgatagattgggaaagcacacaaacagagagcatgagttatgtatcctgcccaagatcactcagccactaagtagtgaagccaggattcaaacttaggaaatctggctttagtacttagaataaaagatatgcttcaagtgtgtttttcctgtgtattca

SEQ ID NO: 417241 - DNA, 283 bp, Homo sapiens
catactccataaacatgaagaagttaaaaataaaaagcaaaaaaatacctagaaaaagaattatatatttggaatttaaaaaactcacatgcttctgaaaaacgtagattatagaggaaataacggaaaatcttaaaatgaattgctgaatgatcattaaaatactgcatattaaaacttgtgggattaagttagtgaatactgagagaaattaataagcttacatgcatacattaaaaagatgaaaactgtcaaattaatcaattaagcgtcaaacttaaaa

SEQ ID NO: 417242 - DNA, 1273 bp, Homo sapiens
ggaaaagaaatactgttttagagaaataacattttcaacaaaacatccctggagtcagattttgagttggggtgggctaatcagggagtcggggctctctgcgtgatgtcagttctatggctaactggtttttctaaaccagccagctgcctatcaaaacagtacaacttttctaggaaatgcaattggcaaagacacttacgatgctgagaagtacacaaggtgaaactgctccagtttttctcatagcagggtcagcaggaaagcaagtggtgcccctggtcccatctcacacaggtgagactgcaccgagaggtaacgtggccctcacagcccaccacgcctggccttcgcccaattctgaaacttcgtaggatagagctggaaagtgccacatggtgaagcgagatccagctgtctgggtggatgtcggagtccataggctgagcagagatggttcttagtgaggttctcgctgccagttgacggtgaaatcatagctgccatttacattttgtgagattatgaaaaacataagactaaagaaactaaatgtgttattcctgtggacacaaaaatgtgtgtttttcagatggggaggggaccaaaaaggaaaaacatttcatcttaaaactttcctaagacaaaggaaaacaaaaaaccatgctctacaacttcaaatttttcttacaaagaaaaatttaatattcgatgagaggttgaaccaggcttaaagcagacatactaggaaatggtgcagcctgtaagaatgccagtttgtaagtactgactttggaaaagatcatcgcctctatcagacacttagggtcctggtctggcaattttggcctgatgtgatgccacaagacccaacagagagagacacagagtccaggataatgttgacagtggtgtagccctttaggagaaatggcgctccctgcggctggtattaggttaccattggcaccgaaggaaccaggaggataagaatatccataatttcagagctgccctggcacagtacctgccccgtcggaggctctcactggcaaatgacagctctgtgcaaggagcactcccaagtataaaaattattacacagttttattctgaagaacattttgcattttaataaaaaaggatttatgtcaggaaagagtcatttacaaaccttgaagtgtttttgcctggatcagagtaagaatgtcttaagaagaggtttgtaaggtcttcataacaaagtggtgtttgttatttacaaaaaaaaaaa

SEQ ID NO: 417243 - DNA, 703 bp, Homo sapiens
gctaggtagtgggaagagccggtaaggcaggtggcatgggcagtggcagaattggccctggtagagagcagagctgatgccatccttttggcaaatagctgacattttatggtgtggtgctgggtgagccccctgtgaggggtgaacagatgtggacaggacttgggtccaggcactagagtggatgcagcctgtaagaatgccagtttgtaagtactgactttggaaaagatcatcgcctctatcagacacttagggtcctggtctggcaattttggcctgatgtgatgccacaagacccaacagagagagacacagagtccaggataatgttgacagtggtgtagccctttaggagaaatggcgctccctgcggctggtattaggttaccattggcaccgaaggaaccaggaggataagaatatccataatttcagagctgccctggcacagtacctgccccgtcggaggctctcactggcaaatgacagctctgtgcaaggagcactcccaagtataaaaattattacacagttttattctgaagaacattttgcattttaataaaaaaggatttatgtcaggaaagagtcatttacaaaccttgaagtgtttttgcctggatcagagtaagaatgtcttaagaagaggtttgtaaggtcttcataacaaagtggtgtttgttatttacaaaaaaaaaaa

SEQ ID NO: 417244 - DNA, 396 bp, Homo sapiens
tttgtttttgtacagagaaaaaggcttttaaatgaaaggtttcaaagaaatatgtctctgtagtttatgactgttaaatattctagaaagggaaagctataagaataggactttgggctggatgcagtggctcacacctgtaatcctgtcactttgggaggccaaggtgggaggatcacttgagcataggagtttgaggccaccctgggcaacatagtgagaccccatctctacaaaaaatttaaaaattagccaggcgtgatgccgagtgcttgtaatctcaattacttgggggtctgaggtgggatgatcacttgagcacaggaggtcaaggctgcagtgaaccatcattgcaccactgcactccaatctgggcaacacagtgataccgtgtct

SEQ ID NO: 417245 - DNA, 350 bp, Homo sapiens
gagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagacgggagttttattattactcaaatcagtctccctgagcgttcagggatgagagtt

SEQ ID NO: 417246 - DNA, 348 bp, Homo sapiens
taggtgttgatctgagctccaagacccctaaaactccttggaatgtttgtgtatgtgtgtgtctctaggaataggcatgtaggcatgcaaagatgtatatgacccaaagaagttaatactaggctagtattttcaaataaggcctccctgatgcagaatcacgaggttatcttttattattattatcattattattattttgagacggtctgtctgtgtcacccaggttagaatgcagtggtgtgatcttagctcactgcagccttgaattcctgggctcaagccatcctcccgcctcagtcctgcatagctgggactacaagtgtgcaccattatacctggctaatt

SEQ ID NO: 417247 - DNA, 395 bp, Homo sapiens
  misc_feature (255)..(255): n is a, c, g, or t
  misc_feature (378)..(378): n is a, c, g, or t
attttggtatcttcttatgaattattatttaaaatctagtgattttaaaatacaggtttgcatcttttaattattgtcaagtaactatttgcatatgaatgtcaagaaatggaacctgtggcatctgagaatccctaggtttgttgtctccagatgcaactcctcttcctcttaaaggcaacagctatcctgacttatgcgttagccactttgtatttcttattatttatttatttatttatttatgtatttttnacaccttctgttatctttgcagcagaaatcagaagttagcatcttgaaattggatccttgacattttaattcattgtgcctgttttctgaactgaaaagtaaaaaggaagtagtgacaatttnccattaagggtattaag

SEQ ID NO: 417248 - DNA, 496 bp, Homo sapiens
aggcatgagccaccatgcttggccctagtttgacttttgcaggtagagaaggacttcgcttaggggtgcatgttgtctcacacattcccttcatgcacccacctccattcctcaatatttctgactccttctggctgatatcacttctcttgaattcaaatatctgtaacttcgcagaggatagagaattgacgagttttgagtaaggcagaggaactcttcctagcatgcaggcttaagggagcttccgagagggtacacaagacctaaccctttggaatttttactgttttcatgcaagacgcattgggtacagtggaaagatttcataagctgtgtgactgtgggtcgatagctttacttctctgagccacagattgcccatttatagaaacaaggtgtagaagagacagatatccatctcgtgaggttctggaattttcaaaggagcaccgatgtttctggcatgccccactggctgccacctcatgaggct

SEQ ID NO: 417249 - DNA, 302 bp, Homo sapiens
gtattgggacctggaatagaaagaggacactcatggaaaaggtgctgaaatctatgtaaagtctggagtttacttaatatacaaatgtcaagtttcttagttttgacaaatgtatcatggaaatgtaacgtgttaacaattggggaaactatgaatgagaggtatttgggacatctctgtactatcattgcaactttcataaatctaaaattattccaaaatgaagtttatttttaaaaatggactggagttaacttttaaataataaaagcaaaatgtgcttattgtagaaaatataaatg

SEQ ID NO: 417250 - DNA, 266 bp, Homo sapiens
gtgatccactcacctgggccttccaaagtgctgggactacaggcgtgagccactgctcccggcccttgtttcatttctattggctgattggtaagagctcattttatatgataggaattgagtctatttttccctggatgggtttgtgggttttgttttgtttttgctatatgacagtttttacagttttatacagctcaaaatctataaaacaagattgaagttttatagattgaagatttccaaccttagttaagaaagtctcc

SEQ ID NO: 417251 - DNA, 3346 bp, Homo sapiens
aattgctactttgcactgcactggactatgactgatttttggcacatgctatcatacacaaagttcctgaaataaaatgctccaggatatcctaggaactcttagaaggctttaaaaagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagagagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagctttgtgggaagcctaaattgatgtatcctttaaaagttcaatctattaaacttgtagcctctcaatgatgaa

SEQ ID NO: 417252 - DNA, 507 bp, Homo sapiens
gatttcatcacgtcgacttaacatggtacgtaagaatttacagtgctagcagaatgctttctgtctttgtttttacagctggaccaagcaacactctccctggccgtgagggaagactaccttgataacagtacagaagccaagtctgtaagttttactcatattcaactatgtgccttaccaggctgctgtcaggcccattagttctaaggccgctgcttctttattggaaatgagcagtgtggctattcaatgaccatattcccaatgcaggaagacttttattcaggcagataaattccactccctgtccttctagaagtctgctcatcaaggctgtacaagtctcagtactcaatgcccttatctagcttgggagacagcactcccaaatgaagtaacaaagaaatgagcttgcagtcattcattcctcagaagtgcagagagctcacgtcgacgcggccgcgaatttagtagtagttagtagtcgacccgggaatttcggac

SEQ ID NO: 417253 - DNA, 3228 bp, Homo sapiens
aattgctactttgcactgcactggactatgactgatttttggcacatgctatcatacacaaagttcctgaaataaaatgctccaggatatcctaggaactcttagaaggctttaaaaagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagagagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatcccgatgcgtccgttttgttcgaaattggtcatatatatgcgcactgctaggacgta

SEQ ID NO: 417254 - DNA, 743 bp, Homo sapiens
accatgaagctctggaccgcagctaattacagagcctcctaagaagtgttaacctcagcattccatagtgaccgacctcctgaaccgggcaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttaggctccaggaaatgctaatgacaaagccgggctgggagcccctctacagggtcattccaaaccttctccggtttcttttgggcgcctcacag

SEQ ID NO: 417255 - DNA, 2891 bp, Homo sapiens
aattgctactttgcactgcactggactatgactgatttttggcacatgctatcatacacaaagttcctgaaataaaatgctccaggatatcctaggaactcttagaaggctttaaaaagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcagggggaaagccaaggcaaccaatattttggtttttataattttcatttgtgaagaattatttgagaaagggtggcgaggggagatttcctgacggcagtttcttaagctgtccattagtagaagagcaagagagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttaggatttccagcaggagagctccagaagcctttctcatggggtgaatggaggaaaggaacatact

SEQ ID NO: 417256 - DNA, 310 bp, Homo sapiens
gatcaatactaattctacagaaatataatagaggtctaaatcactaaaaacaaatcatcatctgaaatacagccaacacattctaatgtttttctttaaaaatatattcttctccttttcctttcttcgtgaattaatgagtcaaactcatgaaatctctacacagtgacccttcatttttatcttaaattttaagaaaatgagaaaattttgatgttaccactatcttttcatctgaacctttgcatagtgctattattccatgacctaatttagtgataagagattctgcttctgtgtctatttaaaa

SEQ ID NO: 417257 - DNA, 443 bp, Homo sapiens
aggcaaaggcctatttaatttgccatagaaaccattttatctgaagcatatgtagtcagtaataggttaaaaaggtggtttataaagcagggaatcattttttaaaattcatacatacatgaaatattttaatataaaacataaatgggtatttgttcgccaatcttttaacatttttaattgaagtaataaatgaatataatttttaagaaacaaaggcttatattatagccatctttacatatctctcagaatttttgtatgctgtattcctagaaatggaaatgcatggtctgagtgcactctggtcaatgaggggttttattttattttattttattttattttattttttgacagtctcactctgttgcccaggctggagtgcaatggcgcgatctcactgcaacctccacctcctgagttagaccctgtctcagcct

SEQ ID NO: 417258 - DNA, 227 bp, Homo sapiens
tttcctgtgataaagttggagtatggctgaatatgggagctgtaggttaggattccatggagacgataatttaggaggggactgtgccatcttaaagatggggcattggagctaagaatcacaggggaggatacgctcaggtggaaggggtgacaggagtgagaagtcacttggatttagggagtgagggagaaatttaaggtaatacccagatttgttgtttagac

SEQ ID NO: 417259 - DNA, 294 bp, Homo sapiens
aaagcctcatgtggtttgcattggacagataggctccagaataataatactgataataatggaagtgctgtttcaatcatgtattatgtattagatcattcagtctttgcaaggactctatgtgatgagtgttattattattcccattttatagacaaggaaattgagagcaacgggagattaaaaatcgcctgaggttatacaggtggtatatggagcagtgagtcaggccagcatccaagtccatgtgtttaaccagtacactgggtacaaagaagggaggaggagacaagg

SEQ ID NO: 417260 - DNA, 301 bp, Homo sapiens
ttttttaaaagaactgtagtaatgtttcataattggtattgtgcaaccgatctgaacagctcttactttatatagagctgaaaatgcccagtgatgttttctttttcattgtaactaggtcctggaatatgttttgaaatggcaaaatccatgtttcaaagtaaaatagctgttgaaagatacaggcaaagttgaatcttctgtcttcctggcaaaaatggcataaaaactgagttgctagctcaaattcctgggtttcatggaattatgattgaggcactacccttgtagtggccgtttc

SEQ ID NO: 417261 - DNA, 301 bp, Homo sapiens
ggatacctccctggggcagcccctgtgctttggggagatcctaggccagtgctgtcaagtagaaatagattggaagccaccatgtcgtttatattttctggtagccacatttaaaaagtgaaaaggacactggatagtcccagctacttgagaggtggaggcaggagaatcacttgagcccgggagttggaggccagcctgggcaacacagcgagatcccatcactcttttttgtttattgggagacagaatcttgctctgtcacccatcctggagtgcagtggcacgatttaggctcact

SEQ ID NO: 417262 - DNA, 520 bp, Homo sapiens
acaaggggagaatcgatacggaggaagagtcacctctaccttggagggcaacccagagagagcaatgttctatgtccaggagagaaaacagtttttagaaataggtgtggtcagaattcaaatgggtaaaaactgaatacgggccatttggaattgactggtcatttatgagcttccatagacagagcctttgggagggggctgtgtaaaactcaaatcgttggaggaatgaagagctgcagtgtaaagttgctggattttcttcttttgaatagtacctgggacaacttttcattggtatacaagtttatgatgtagaatggtgactccatggaaggacccatttgaacacccagaaatcttagaatatggagactgtgcctggaggctccctttggttaaccggtgtcaggaagaccctagcaaagagaattcatgatctgaaaggagaggaagaattgcttatagttgagaacaattatttgttccttgcattgtccacttccccttccagacttcc

SEQ ID NO: 417263 - DNA, 635 bp, Homo sapiens
attgcccctaatcgagaatgccattctaggctgaaaaatactataattccgtgtctagtgaattttagtggttgcaacgaaacaaaactttgggtgttcgccagcatgctttgtagtgggagacataagagatggaagatacagaacagtggggcaaatcaaggctgaagccccacctgggttaactagcacgggcagcatactggggacagttccgcaacacgtgcgcgggaagacaatgctctgagccatatttaagtctcaggtatccattcatggtcagtgggtaggaaaacacgtttcttttggagtagttatattgtaagccaacaaggtgatgaattattgaatgggttctttttgtataaacatacttatcatctttatttttcatcagttttgtaatgaacaagggaaagcagacacacgaaaacattttgcaaagagcttcaaatgtgaactcttttttggtgaatggccccctggtttgaggtgttatttccttcttgagtggtctctctgcttcaaggacactttttaatgcaaccattgttcagaaaaagtcaccctgttttctaactctttcccttttactcccactctcttttctctctgtctctctctctctctctctt

SEQ ID NO: 417264 - DNA, 1307 bp, Homo sapiens
accaaccacaataagaagcaccaattccccaattttttaatatgctgagccagagacatccccttagtggaactgtcttcctatcccccaccactcacctaacaaagtatcaactccaagagctatgaaaatcagtgccctgactcctacaaagcctgagtcatgagatgggggaaagggcgtgaagccgaaagtacagatgttcacaggaaatcccaacccttcaagcctgatgtctcatcttttgcaagcagctaaggagcttttcacataccatcattaaaacaagacccatgggaggaagctggctgcaggatgaagaggaaaaaacagaagactagtacactcaagacataccagagaagatccatttcataaatatttattgtgtgcctgaggtgccaagcactaggctaggtatgctgtggccaaggccaggggacctctggtaagccagagcggggcaaaagcaaacagagcggaactccactccactgtgataacttgcaaaagattagttctgctgttcgccaccgtgctggatgcagcaccagagacaggacgacacgaggacccagagggcgccgccatgctcatttcagaaggtgcagcctccgtgtccgtgggtccgcacccatggaggcaactaaccgtggatcaaaaatattcaggaaaaaaaaatggaaaatatacaagaaaaaataatacaaatttaaaaaccaacacagcacaagaactatttacacagcatttacatggtatgaggtatttgagtagcgcagagatgagttaaaggatacctgaggatgtgcataggttacatgtaagggatttgagcatcatccatggacaggtattcagggaggctccaggaaccaatccccattggacagtgagaagcaactgtaattccgtttttctatgtagagataaaaacaaattcagtggatttaaggctgggccagtcaactgagcctgattcccccagtctgaatgatgagtgggactctgaattcctttgacagaggtggacccattcaatcatcagtgaaatggggtccccacagccaaaagtttccacaggactctttacctcctttccccaccccaagtgagttgtcagaggacctctcctgaactcacagaacaggtccaatcaagttccacctccccattcatgtcctttccagaagctgggcgcggtggctcacgccctaagttccagctacgtgggaggctgagacaggagaatcgcctgagcccaggatttcaaggccagcctgggcaacatagcaagatactgtctc

SEQ ID NO: 417265 - DNA, 313 bp, Homo sapiens
ctctatacgaatcatgtgaattagactcacctctctttcagttgcactgctcgtacttcagtacatgtaggacacagtagagagaaaaatatctgctttttacttttaaagccaattgctggtctttatttctgcaagtcttttcttctaactcagctttcagttctctttcttaattcaactcttgcaactaatcctcatacttcagaccgaaacttaatgggaaaagatatgtgagattcatctctactgagaaaacctttcatgatgtgattaatacttatcctcaaggtctcctacaagtgaaggacaa

SEQ ID NO: 417266 - DNA, 423 bp, Homo sapiens
ttgaggtattataagagattgcacacatatggtcatttccatattttacagttgagaaaaccaagaactttatgacttcatttattcagcaacaaaaatttgccaaatatttattgagtctttacatatgccagacagtgttctggatagtaagaatatatcagtgaacaaaagacaaaaaatttctaattttatggagcattttggtagcatttttctaatttatttttagtttttaagttttaacttttattatagattaaagggtacatgtgtaggtttattattacatgggtaaattgtgtgatgctgaggcttggggtcccaatgatctcatcacccaggcaataagcacagtacccaacaggtactatgatcggcaccactgcactccatctgggcaacataacgagactgtatcta

SEQ ID NO: 417267 - DNA, 2103 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417268 - DNA, 646 bp, Homo sapiens
cacacccaaatgtaaaaatccttttgaatgatgcctttataaatctttctctcactgtgtatttaagtgcaattaacatatgtcacgaacttgaaagttttctaaactcaataaggtaatgtccagttgttattcacagctctgtaacctcccgttgcgtcaagtctaaaccaagattatgtcacttgcaacaaagttattcagttcagaaaaaaaaaaaaaaaaaacttgagactagttccttgtaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcac

SEQ ID NO: 417269 - DNA, 879 bp, Homo sapiens
agcgcgggagtccccgccaggcccacgccggccggttggggcgaagggtgtccccggctgtgccagccttgagtagatcttttcgctagaagattcctgtgccctcaggtgggcgccctttcctctcaccactccctctcctccggagcgggccgaggtgagcgggtgccggccttggggctgcctgagtgctaggcagggtgtggtcctgggcatccttgggcctaccagcgagccctgctcagggtgtcgggcgccggcgggcagtactggcgggggcggccgcagtcccggccttgggcccgttaagggggccggcgtccctccatatgccccccggggcttctcggacttgatgggccctggtcggttcacgccgcttgtcccattgatcctcacgacaagcctgggacgtaagaacggcggattcgtaggcatttttcatccatctcggttttgtggatgaaaagactgaaaatggaagacttgccaaataaggaaaatatgtggcgtggcctgctggtcccctgacagctaattgagaggccttaactctccagaggattcgggccttctgtgttacatagagaatgctcatctctcccaggctactcctaatatgctagggattgtgtggaatgctttacaaacattacccaatttcatcctcttggtaattctacttggttggtattatcgctgttttaaaaaatgaaataagaacgcgtgactaaatgctagggggattctaatgcgcattcggttgcctcttccagagcacgtgtttgttttttgtttgtttgttttttgagactgcacgtgtttgttttttgtttgtttgtttgtttgttttttgagactgagtctcactctgttgct

SEQ ID NO: 417270 - DNA, 413 bp, Homo sapiens
ctccacccgacggggtggggccctggctgcacctgaactgtcacctggagtcagggtggaaggtggaagaactgggtcttatttccttctccccttgttctttagggtctgtccttctgcagactccgttaccccaccctaaccatcctgcacaccccgtcgggtggagccgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccgtcggatagagcgggccgagctt

SEQ ID NO: 417271 - DNA, 2277 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaaaaaaacacacgggggcggctaaaaattcccgagggcaagttagcgatccgttttgtaaagaggccctatggaggttataaacaggaggcgcgtaaagcgagtgggaaacgcttgcgtctctgggacctcctgtgtgttggggcaccgaaagcggaaatgttgtggaacttgcga

SEQ ID NO: 417272 - DNA, 2161 bp, Homo sapiens
  misc_feature (2133)..(2133): n is a, c, g, or t
  misc_feature (2161)..(2161): n is a, c, g, or t
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaaaaaaaaaaaataacataaaaaaaatgcggnccgaattcgaggctactttgcccattcn

SEQ ID NO: 417273 - DNA, 2168 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactgagctggagtttcctggatgggtgcagtggctcacacctgtaatcccagcactttgggaggcctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417274 - DNA, 1939 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccacctggaaagagagacccatttgaaaataataatattttacaataaagtattgttagttatgaatataagtggttataaaagtaatacgtctatccaaaaaaaaaggggggtaaataccgaggcagtaggtcagttggaagggcaaaggggttaaaaggggggaaacgggaagggtggagacttggggtgacacagacgaaaatggcatgggggtaatacgaagagaaggaaaaagaaaagaataa

SEQ ID NO: 417275 - DNA, 2035 bp, Homo sapiens
aggacgccggagggaaaggaagggggagcgcgcccagcatcgcttgggcctcctccacccgctcaggaggggaaacaggagagccgggagcacaacagcctcgcgcgcccgccgccgcctcagccttaggggaggccactacgcctctggttacatttcttgatcatggtatctccccagctagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417276 - DNA, 1727 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417277 - DNA, 1338 bp, Homo sapiens
  misc_feature (14)..(14): n is a, c, g, or t
  misc_feature (18)..(18): n is a, c, g, or t
  misc_feature (34)..(34): n is a, c, g, or t
  misc_feature (38)..(38): n is a, c, g, or t
  misc_feature (42)..(42): n is a, c, g, or t
aacagttataactncgcngggcacagtggttcangccngtantcacagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417278 - DNA, 1831 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactgagctggagtttcctggatgggtgcagtggctcacacctgtaatcccagcactttgggaggcctagcgccaggcctacgctgacggcacacacactagcacggctgaactactactgcacaaccctccctcactacaacttcctggcactaaaagtactgctactgacttctcgctcgactgcgcactgactacaataaagtccctactcacagaactgcaaccagcgcaccccaacacacacggcagcacgcactgcgtgcctgccgcacgcttaccactacttcactcttacgctgcccaaaaagcggcaccttcccttctcccaaacaaccttctagccacttgactaaccctgccccccccctcccgccactctacttcacaccctttgacccaacccagctgcactgcctccacgcaacagctcgccccctgcgccaaccaaacatcacacgaagcttaagaagccatccgcgctttgaatacccacacgcacaggcggcacatccttgggctatctcacaccaccaccgctcacagcccctcgaccttcccttgcctccctggcctccccgcctttccctcctctcccctcgcgcaaaacccctctgctccacacctcggcccgctccctcaacttccgcctcaactctccgaccccgcacacttcctttccacacccgccccatctctccctagccacctcatccacaccctcaaaccccactcatctccctctccgcacccaaccgccctcctcacaacgcaccccttcttctccccccccagcccctccacgcctgcccccaccagcccctcctcctatctacgcgcc

SEQ ID NO: 417279 - DNA, 1277 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttgtatttttagtagagatggggttttgccatgttggccaggctagtattttgtcagtccaagcagttcattaa

SEQ ID NO: 417280 - DNA, 1403 bp, Homo sapiens
  misc_feature (14)..(14): n is a, c, g, or t
  misc_feature (18)..(18): n is a, c, g, or t
  misc_feature (34)..(34): n is a, c, g, or t
  misc_feature (38)..(38): n is a, c, g, or t
  misc_feature (42)..(42): n is a, c, g, or t
aacagttataactncgcngggcacagtggttcangccngtantcacagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactgagctggagtttcctggatgggtgcagtggctcacacctgtaatcccagcactttgggaggcctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417281 - DNA, 1381 bp, Homo sapiens
gtctataaccgtgtccatcagtatgtatctggacttggagtgataatcggacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactgagctggagtttcctggatgggtgcagtggctcacacctgtaatcccagcactttgggaggcctaggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417282 - DNA, 1768 bp, Homo sapiens
  misc_feature (32)..(32): n is a, c, g, or t
gacactatagaaaagttgtaaaaaaagcaggntggtacggtccggaattcccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactgacagggtcttggtggcgcatacctgtcttggtggcacgcacctgtcatcccagctactcaggaggcctgaagtgcaagaatcgcttgaacccgggaggcagaggttgcagtgagcagagactgcgccacaactacattccagcctgggagacagagtgagactccatccccccaccgccccccaaaaaaaggatcagagacaagtggaggaggaaactgagaatcaaggatgttaggtaacttgcatcaagttggccagcttgatctctgagtagtggcagaaccagaacccgatttgaaccagcctcactctaagccccagcccttgccacaccaccaccacccatcaattacatatccacaaagaacctccgtctggtcacgtatgaaatgagggattgctgccgtccagttgggaatcctggagtctgaatgccccaccacagacggcagtgatcagaaagatattcttctctggggagggctgggccccatccactccccagtcaactccccacattccagggagatgcagtgagctcttctctgcagccagctcaggctcatgactgcactgccagggaagagagtaacattgctccagacccatttgtacctgactgctctaaaggttaccttggatctgggaaagtttgctgagtaaattaataacataagcaaggacgtaagaagaactttaacctacctcacagaattctatactaagaggccaaactgtttttgagaaccaaaggacaatgcatacaacgagtctggttattcctagagaatcctaactgggagct

SEQ ID NO: 417283 - DNA, 1274 bp, Homo sapiens
  misc_feature (32)..(32): n is a, c, g, or t
gacactatagaaaagttgtaaaaaaagcaggntggtacggtccggaattcccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctgggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417284 - DNA, 426 bp, Homo sapiens
cccccctacaacttcctgtactctagcaacctcctgtacccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417285 - DNA, 678 bp, Homo sapiens
tatctggaagttatcaaagagaggctgaagaataacccatatacgtaattggtttggggttgatgaacagaggtcgaaaggcataaaagagaggctgaagaataacccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtaagtaaaggatttgatacatattctaattttgttttttcatttgtttgttttttgagacggtgtctcactcagtcgcccaggctggcgggcagtggcacgatctcggctcactgtaacctccacctcccgggttcaaacgattctcatgcctcagtctcccaagtagttgggattacaggcgcatgctaccacgcccagctaatttttgtatttttagtagagatggggttttgccatgttggccaggctagtattttgtcagtccaagcagttcattaa

SEQ ID NO: 417286 - DNA, 2444 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaaaaaaaaaaaaaaaaaaaaaaaaaaaaaaaaaaaaaaaaaaaaaaaaaacaaaagaaaaagaaagagaaaaaaaaaaaaaaaaacaaaggggggggggaggaaaaaaggacggagggaggagcacagaagacggagaagagtaggaaggggggggtgcacaagggcgaggataaagaggaggacggggaaaaaagagggggagagagaaaagacggagaagaaagagagagaaacccaaagaggggagagagagaggaggaaacagaaggaaacgacggcgagaacacaaggagaaggagagggaaccagggagggggggggaagggggaggagttaaatcg

SEQ ID NO: 417287 - DNA, 1823 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcac

SEQ ID NO: 417288 - DNA, 1447 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcac

SEQ ID NO: 417289 - DNA, 2008 bp, Homo sapiens
agcgcgggagtccccgccaggcccacgccggccggttggggcgaagggtgtccccggctgtgccagccttgagtagatcttttcgctagaagattcctgtgccctcaggtgggcgccctttcctctcaccactccctctcctccggagcgggccgagcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417290 - DNA, 1504 bp, Homo sapiens
tatctggaagttatcaaagagaggctgaagaataacccatatacgtaattggtttggggttgatgaacagaggtcgaaaggcataaaagagaggctgaagaataacccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattaaacttgagaccagtgatgctcagaagctcccctggcacaatttcagagtaagagctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417291 - DNA, 1801 bp, Homo sapiens
ggccggggggggcggggcctcgggactccgcccacgcctccgtctcctccgcgctccgccacagccggccgacaccacaccagccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactgacagggtcttggtggcgcatacctgtcttggtggcacgcacctgtcatcccagctactcaggaggcctgaagtgcaagaatcgcttgaacccgggaggcagaggttgcagtgagcagagactgcgccacaactacattccagcctgggagacagagtgagactccatccccccaccgccccccaaaaaaaggatcagagacaagtggaggaggaaactgagaatcaaggatgttaggtaacttgcatcaagttggccagcttgatctctgagtagtggcagaaccagaacccgatttgaaccagcctcactctaagccccagcccttgccacaccaccaccacccatcaattacatatccacaaagaacctccgtctggtcacgtatgaaatgagggattgctgccgtccagttgggaatcctggagtctgaatgccccaccacagacggcagtgatcagaaagatattcttctctggggagggctgggccccatccactccccagtcaactccccacattccagggagatgcagtgagctcttctctgcagccagctcaggctcatgactgcactgccagggaagagagtaacattgctccagacccatttgtacctgactgctctaaaggttaccttggatctgggaaagtttgctgagtaaattaataacataagcaaggacgtaagaagaactttaacctacctcacagaattctatactaagaggccaaactgtttttgagaaccaaaggacaatgcatacaacgagtctggttattcctagagaatcctaactgggagct

SEQ ID NO: 417292 - DNA, 1272 bp, Homo sapiens
  misc_feature (32)..(32): n is a, c, g, or t
gacactatagaaaagttgtaaaaaaagcaggntggtacggtccggaattcccggggagccgccgccgccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctgggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaatggaatttttgcattattctcggtgataccaagaagtgaatctggcttttaaacagtcagcctgactctgtactgctcagtttcactcacaggaaacttgtgacttgtgtattatcgtcattgaggatgtttcactcatgtctgtcattttataagcatatcatttaaaaagcttctaaaaagctatttcgccaggcacggtggctcatgcctataatcccagcactttgggaggccaaggtgggtggatcacctgaggtcaggagttcgagaccagcctggccaacacggtgaaaccccatctctactaaaaatgcaaaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417293 - DNA, 892 bp, Homo sapiens
agctgagcatgagtggtgtaacccacatacgccatgaagctcgcatggctctggagaaaaagctgaactaggccgtattggatcgtcatgccttgggttatgcccgcacggacccacatctctgtgacttcctggagactcacttcctagatgagcaagtgcagcttatcaagaagatgggtgactacctgaccaacctccacaggatgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttaggatagttaagaaagctgcctatgggcggaggcagaggctgcagtgacccaagattgtgccactgcactccaccctgggcaacagagcaagaccccatctcaaaaataaataaatatatataaaaaataaaaagctatttctagtttatttcactataaagttttgctttattaaaaagctaataaacagctattaatcacagtgtattagtatttgttacatttttgtatttcactatctttatactatataatatggtaacttgggtaccgggggaactttaaaatttcatctcaaaaataatttttaaaaagcctgaggtatgatatagcataaaagattgagatgaaaatatatttccctgtaagctgaattactcatttaaaaattttaacttctatatgggacccgaattagacactgctgaatcctgtacagccttactcataaataaagtacttactgaatttcccattcaaa

SEQ ID NO: 417294 - DNA, 6586 bp, Homo sapiens
  misc_feature (3)..(3): n is a, c, g, or t
  misc_feature (5)..(5): n is a, c, g, or t
  misc_feature (7)..(8): n is a, c, g, or t
aanantnnaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttctttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgtttaatggctgcgttttgatcgtctacaacaaggttacagtgccctctggtggcagtcatcaaaatcgcttctagacttgtttttatttttaaataaaagatctaattatattggaaatc

SEQ ID NO: 417295 - DNA, 6297 bp, Homo sapiens
ctctttggtcaacatttgctttctatttgaattttaggtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttctttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgtttaatggctgcgttttgatcgtctacaacaaggttacagtgccctctggtggcagtcatcaaaatcgcttctagacttgtttttatttttaaataaaagatctaattatattggaaatc

SEQ ID NO: 417296 - DNA, 772 bp, Homo sapiens
tattctttttttggttttatttgtgaaaaatagactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaaggtaaaccaataaattatttattcttcgttagagagtgaatatttgtttgtatatggaactgtaatattaatttgtaacaagaatggttaaactcatgaatgatgattcaataattagtcaagtggggctatgcccagaggttgctttgtagaggagtttgcatgtggacaactccagctactaggccactaattacttgctataagtgtcactaaccaattgcttcagaactccaagacatgtgatcataaaataatgatacttttccaccaatcggagaaaaaacttgcctcttttttggtcccatgtcccatgcgctggagcctgtggtggttaaatcaggattttgtagtctggtattcataa

SEQ ID NO: 417297 - DNA, 1773 bp, Homo sapiens
ctctttggtcaacatttgctttctatttgaattttaggtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcagtgttgctttctcaaagaaataaacatgtggctggaagtgtttaatggctgcgttttgatcgtctacaacaaggttacagtgccctctggtggcagtcatcaaaatcgcttctagacttgtttttatttttaaataaaagatctaattatattggaaatc

SEQ ID NO: 417298 - DNA, 3547 bp, Homo sapiens
acagaaacaatcttcaatagaacttaaatcatgtgccatttaatactgttgctggacagctgataaaactaccttctgacaaagtttgatttaattagactctaataaaaggtcctatgagactttctaaaagactatattgggaagaaagaaacctcagaaaagtctaaattatcaagtagtaccatttaaatactcttactggacagctaataagctaccttcagacaaagattgaatgattaaattgaactccatacagaactgctaaggtgtcttcaaaaaggacttgagaagatgaaagcatctttagaagggccacttaaattcacttgcttgatagaaataaagcctcaagcaagttgttataacttcaggattcgacttcactgactctaagagtatagacatccataatttgaactaatgaatagtccacttctgttcattgcttctctgtcacccccatttgccactaccataatgagtgatagatacatcttcatcacctctggaaatcatctcaggatctaaatggaaactgtataaagcctatcatttttactgatttaaactatgtaaactcattattctttttatgtaatgtgctgttgttattgtttacctgcataaaaatatttatgagggttttcaacagtttacttgagacctcatttttgcccatttttttccttcccgatatcatgatctcctcagctgaactttcttaccttgggggttgttcaggaactgactctcatggggaaagagggattactatttctgtgttcctatctcttggtaactgcttaaccacagtcagtcttgaactaatggaaggagcactggacttgggttcttgagacctgggttcatgttcagttctgccactgattattgtgacattgggccagtcacttgatttctctgagcctcagtttcatcacctgttaagtgaggatagtaatacctggcacaaatatcacaatattagtgataattgaatataattataagtacccaatggctattaaaagtaaaactaggaagtgctgaataaccataatatcattatatttgtagcattttggaccttatcaatgaacaactgagaaaactaggtttttgaattcttttactttttaaagtaacttcctcccatttttatgtcaattatagaaaattttaaaaagaaaattaaatgtgcctataattttataagccggaggtaactaagttggtatttttcttcttagtacctctttgtctcatcataaattgttcatcaatgtcaaaaacttggaaaataaagataagcatatagaaaaaaataaaaaccacccataatcacaaatcccagaagcaatgttaatattttggtggatttatttccagtctttttctatggctatatgtgcacatatataatttttacatagaaaaagtcataatgcatacagctttgttgcttttagcatttttatcatgaatattttcctacatttatgcaaagtatttgtaaatatcattttcaatggtgtataatatttcatcataggatgacatcatggtttagttaaccattttcttttgttggatatttgagggtctttccaaatttggccattgtaatttcacaatgtctttttcattacctaactgaaaatatttgctttggtgaaagcagaggattttttgttgtttgtttgtttgtttttgaagaagtccttttaatagctacatttcattgactaagtggaacttcaagagacaggtagaagaaaaaaaaaaagaaacagtagatgtaatttcaagattgaggatttattttgttagtgactgttccagaagctgaattttggtgttagagcaattcaggagggacagtttgccaccattttatgatactttactgtagaaaagttttcaggatttagaccaggaaagagacatcctaaccatatgggttgattttattttatggaccctgtgaagtctgggactgatcaggtttctcttttgttggctactagaaagcttggagtcaaatgtgtggtcaatgcatagcacttgtaatgggactctacggtatgtatgcactttgtattagctttctgccaggctccatttcgtgttcctatctttattgtttttgttttttccttttactttcttatctactttgaatttatgctatcatgttgtattttgtgtattcttgtaagccacctgacatccatcttggaacatggtggggaataaacacactaataaataaatacattaataaatacatgaataaataaaccaataaggaaaaaacaatgaggcaaatgaatgcagccaggactctgaaaattgcatagtgcctccaagaataatcaatgttaaggacttgaagcttggaagaacatattggaaagaagcaggtgaggctgcgaggctgcatttagaggtgacgtgttctgtgtgacgtctgtgtctactgaagcatgcttatatgtcttgtgtcttctgctgcacttgagcattaggtgtgtttcagaggatatgcagtgctgcgtaatggactgtgtctttagagggcacagttcatgtgcattttatttgtggggaatctagagagatttgggagttggtgagcctgggaatgatgtgatgatcctttttcatggaggcataggaaggaatcattgtatataaatcaaatcaagacaaataggaagtttcctaccatttactaactagttactgggtgccaagctatgtgccaggcactttacatgtattgatttaacacttaacagccactctatattattccctttttacagatgaggcaatttaagctcaaagcatttaagtagacaaccaacctagaatcacatagcaaatgacagaagccagaggcctcccaagtctctctaactccaaaccctatgcttactctactatatcacactaccttgcaataggacaaagggaatatgtggtaaactatgttcccagcatctaaaagccaggagtggttttcatttttctttaagaagatgatagtgtgatttgaaacatatctgaatttcagaagaggggacttttaaaaattgccactcataaggaaagaaagaactttttcacatatttttgaaagaaacgatggtgagaagatattcttgataatagagatatgctaacatttgctttgggtgttttgtaggttagatttttttggtgtgtactttataggcttgcatattgcttactttaaacagctgaagttctaagtaagagtgttcatatatgtgaaagagttcttaaagtactatatagttttgttattgtattgaatatatattgttctaattcctagagtatgtcatcttctatatactctatacagcaggaatccttgctgtacaacaattatattaaagaaaactctcagttatcctttatggtcttgtcaatcaaatgttttggtcaatgcatattactaactttcatctaattaatgcacaataaaatatacttagtgtgaaaaaaaaaa

SEQ ID NO: 417299 - DNA, 5019 bp, Homo sapiens
  misc_feature (1160)..(1160): n is a, c, g, or t
ttttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccaacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaangtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtagactgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgggtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagccccaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccaccgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctcccccagaagcgcagcatacccctgggacccctcggccactgcccactcggggagccttctctgtttctggggcctcccccaccatagctctgattcccaccccacataggaatagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgcttt

SEQ ID NO: 417300 - DNA, 4921 bp, Homo sapiens
  misc_feature (1160)..(1160): n is a, c, g, or t
  misc_feature (3504)..(3504): n is a, c, g, or t
  misc_feature (3523)..(3523): n is a, c, g, or t
  misc_feature (3606)..(3606): n is a, c, g, or t
  misc_feature (3641)..(3641): n is a, c, g, or t
  misc_feature (4053)..(4053): n is a, c, g, or t
  misc_feature (4065)..(4065): n is a, c, g, or t
ttttcatgcttgctccctggcctgaatctagaaagtaaaactttgctggaatgaagttggggttgaaacagtttcggtttgtaaccatactgtctctgtctcatctactcagctctgcctttgtaatgtaaaagcagccatagatggtatgtaaatgaatgaacatggccatgttctgatagcattttatttacaaaaacaggcagtgggctaaatttgggctatagtttgccaacccctcttctaggcaaagaactgcctgagcgtaggaagctggactgaggttctctgctagtgtgtgaacttgtggatgccaaagccaatctcttcccttcatgtcagacactttgcaaatgttacctcttttagatctcccattaactctaaaaggtggagggtgctattatgcttccatttcatacattgttctaagagattatcacactactagtaagttaggatagtaggaatttgaacttcaggtctgtcagaccctaaaaccccatgccctggaaatggttttctaaggctggcctgtggttcgttggttgatttcaattagaatttaagaattttttcagaatacatctaggtgtaaagatttttttgtcaatattactccacaaactagattatttcttttggcctgataactcaggaactttcttgtattacttctctcccttcttactggtttcttctttggactctcctgttgcacaggtattggatctcctggacctatccagttcctttcttttctatgctgtcatatttttcatctcttattgctctgtgttctgggagcttccaggacagttgctctttcacacaactaatttggttttcagttatatcagttctcctatttagcctttctttttttggaggcagggctggggcagactcatgctctgtcgcccaggctggagtgcagtggcctgatcacagctcactgcagccttgacctctgggactcaagcgatcctccagcctcagcctcccgggtagctgggactataggcatatgccaccatgcccagctaatcaggtgtttgtttgtttgtttggtagagacagactaccagagtctcgctaagttgcccaggctggtctcaaactcctggcctcaagcagtcctcccaccctggcctcccaangtgttgggcttacaggcatgagccaccgtgcccggccctgttaagcctttctatctagattttttccctcctaatcatgttggtgtttttttgtttgttttcatttttgttttgttttgttttgagacggagttttgctcttgttgcccaagctggtgtgcaatggcacgatctcggttcaccgcaacctctgccttccaggttcaaacgattctcctgcctcagcccccagagtagctgggattacaggcatgtgccaccacacctggctaattttgtatttttagtagagatggggtttctctatgttggtcaggctgctcttaaactaccaacctcaggtgatctgcctgcctcggcctcccaaagtgttgggattacaggcgtgagccaccatgcccggccagtttttaaagaactccttcttactactcagattactcctttttaaatagtggcttttaaaaaatatcaatgtagactgggcacagtggctcacacctataatcccagcactttgggaggctgaggcaggctgatcacctgaggtcaggagttcaagaccaggctggccaacatagtgaaaccctgtctctactaaaaatacaaaacttagccaggcctgcagttccagctactagggaggctaaggtgtgaggatcgctcgaaccaggaggccgttgcagtgaaccaagatcacgccagtgcacttcagcctgggtgacggagtgagactccgtctcgagaaaagaaaaaaaaacgcaatgcagcagtggctcacgcacataatcatagcattttgggaggccaaggcaagaagatcacttgagaccaagagttcaagaccagcctgggcaacaacaagaccccctccccccatctctacaaaaaatttaagaaaaaaaatttttttaaatcaatatggcatcctgttgcacaaattgcagtatattttgaaagatttattctgtttcttttgtcacctccatttcccagggctactgttgctctgtttgagctatgccctggaccattgagtggcttagactgtgctcacaataggtgtcccttcatcccttcagaagacaaacatggacatacgtcctaaaccaggaaggggttcagtgatggctcaggaaaatcggggcagggtgcagttatcctctaggcgagctgccgttttctttttcctttcctctcttgtggttgcctagaattagcttgggcactactatggtttttttctgtctgcaggccccaggagaccttctgtggacccaatatacttaacaatcatatgcagtgtagacctgctctggtgtcaattctaaccaaaacaaaaaaaaagcatttatgagacactcagggaaattcaagcagtaactgaataatattagatgatactaaggaattagtgttactttttaaattggataatagtattatgtttatgttaagaatcttgatctcttggtgatacatacctaagtaattgcatttgaaatgctaggtctcggatttgccttaaaagaattcagttagaatggcgtgggtatagaccagtggttccttactgggggctatttcccccacaaaggcatttagcaatgcttggagatacttttggtcatcaaaattgggaatttgctacagacatctaataattagaggctagggatattgttaaatgtcctacagtgcacatgacagacccacataacagagaattgtatagcccaaaatgtcattagtgtgacgttgagaaaatatatatgcagcatatgttttgtaaaaaagaagcccttaccagtctctgtgacaaactctctactctgtgtagagcactgtttttccagctgagtctagatgggaagccccgcttgtcatttgggctgtgggtgtactggtgctgggttggcaggcctttgcttaagtaccatcctggtacctcaaggtccactttcaaccccagtcccaattccctctgagcttgaggtgtttccaggcccaaactggtagaactagtacttagttttcagctggaggctctttggctctgtttgatctcttggacatcgagtctggtctgttttgtcttccagaaatctctcaaagattctgatctacatatgccaccgtttgctgcctttcagatatgctgttgattcattagtatttttatatttcttctaccatgtcagtgtgctttgggggaagatgaagtaaattcatggatttagcccagtgtcttaagccaaaggtgcctaattactttcttcttcttctttttttttttttttttgaggcagagtctcgctccgtcacccaggctggagtgcagtgncacgatcttggctcactgnaacctccgcctcctgggtacaagcgattctcctgcctcagcctcctgagtagctgggaccagaggggtgtgccaccacacccnctaattttgtatttttagcagagacggggtttcancatattggccaggctggtcttgaactcctgaccttgtgatccacccgcctcggcctcccaaagtgctgggatgtgcctaattactttcttataatacctgatatactgccccctgttgttggaatttaacaaagacatttagtgataaattactatttttttttgttctttggctcaacgtaatccattgtttgttttgtgcctgttatgtgtgagaccctgtgctaggttttaggtgtacagtgagaatgaagcagacatgtaatccttgctcttgtggaatttatgctataaaggagggatattcattaatcaacaaagtcaaatatgtaattataaagtgtgagaggtattatcaaggaaaataataaggtccttgccttacaaaaatagtataggaaataacagcaantttttttttttnttgagacagagtctcgctctattgcccaggctgaagtgcagtggcgcaatctcggctcactacaacctctgccccccaggttcaagcgattctcctgcctcagcctcctaagtagctgagattacaggcatgtgccaccacacctggctaattttttttgtatttttagtagagatggggtttcaccatgttggccaagctggtctcgaattcttgacctcatgatctgcccacctcggcttcccaaagtgctgggattgcaggcgtgagccactgtgcctggccgtaacagctaaaatgaagtacacactgtgtgctagttactgtgccaacaactttacatgaaagatctcatttaatacgcagaataacttatttcagaaatgaggaaactgagacttatgatcctaatttagtattaggaagtcagagaagacctgtgtgggaaaagtgacacacagagaaccagacaagtaggagataaccaggcaaagaacagagagaggctgtgtaaagcagaaggaataacatgctcaaaggcctgaggatgaatgaatgaaagcatggaaggacaccagtggctgaaattgagtgagcaaggaaagagtgcaagagatagggcaggtaggggctaaatcgagggggttgttagagtccaggataaggagattagatttcattctgaggcatgagaaactgttggagggttttacctaagagtgggacacaacctgagttgctttcctagagatcactctgctttgtggagaatggattggcaggggcagaggcttactgtgatccaggtgagagaggatggaggttgggactacactggtggcaataaaaaaaatgc

SEQ ID NO: 417301 - DNA, 304 bp, Homo sapiens
  misc_feature (213)..(213): n is a, c, g, or t
  misc_feature (266)..(266): n is a, c, g, or t
  misc_feature (285)..(285): n is a, c, g, or t
ccgaccccatttctcttttgcaaaaagactatattccccaaacttctttctcatactttaaaatttctatttattatatatcttatagcgtacatgatatattcgtacaatgttacatgcttataatttataaatatgcatatgttgcaggtgcctgcttacaagtttgtcacacataagggatttgcccaggctggtcacaaactcctgggntcaagcgatccatctgcctcggcctctcaacgtgctgggattacaggcgtaancacttgcacctgaccccanctttcttcgaccccgcccg

SEQ ID NO: 417302 - DNA, 344 bp, Homo sapiens
tgcaaataatgtttttattcaatgtcaacttcttattaaaacatcccagggcttgactcttctgagtcttttatatactttttttctacaacaaaggagaaagcaatcactattgatttgggcacatatcaaaaaatgaaaaaagagaaataaataaatagttgcatttcaattgtggccaccatacagctaatagtttatcataactcttaaaggttggtccctaggctcttatacaggttcaccctttgctgacctcttacaatctttctgtcagcattttgaatgctactgattctgtgagtaatattttcaacggaggtcagacaggccagtaagtccag

SEQ ID NO: 417303 - DNA, 5633 bp, Homo sapiens
aaacatcacctgcaggtcccaaaacacccaaagctcaagccgggcctgcagctacagtttccaaagcacctgcagcttccaaagcacctgcagctcccaaagtacctgtgacccccagagtctccagagctcccaaaacacctgcagctcagaaggtgcccacggatgcagggccaaccttggatgtagccagacttctgagtgaggtccagcctacatcaagggctagtgtctccttactgaagggccaggggcaggctggaaggcagggtccccagtccagtggcaccttggccctcagcagtaagcaccagtttcagatggaggggctcctgggggcttgggagggggccccaaggcagccacctcgccacctgcaagcgaacagcacagtgaccagcttccagaggtaccacgaggccctgaatacacccttcgagctgaacctgtcaggggaacctggaaaccaggggttgcggcgagtggtcatcgatggcagcagtgtggccatggtgcatggcctgcagcacttcttctcctgccgaggaattgccatggcagtgcagtttttctggaaccggggacaccgagaggtcactgtgtttgtacccacctggcagctgaagaagaaccggagggtgagagagagccactttctgacgaagctacactcgctcaagatgctttcaatcacaccctcccagcttgagaatggcaagaagatcaccacctacgattataggttcatggtaaagctggcagaggagacagatggcatcattgtcaccaatgagcagattcacatcctgatgaatagttccaagaaactgatggtcaaagatcgcttgctgcctttcacctttgcggggaatctcttcatggtgcctgatgaccccctgggccgtgatggccccaccttggatgagtttctgaagaagccaaacaggttggacactgacattggcaacttcctgaaggtgtggaagacccttcctcccagctcagccagtgtcactgagctgagtgatgacgctgactctgggcccctggagagtctgccgaatatggaagaagtcagggaagagaaggaggagaggcaggatgaggagcagagacaggggcagggcacacagaaggcggctgaggaggacgaccttgactcttcgctggcgtcagtgttcagggtggagtgcccgtccctttcggaggagatcctgcggtgcctcagcctccatgatccccctgatggggccctggacatcgacctcctgccaggggcagcttctccctacctgggcatcccctgggatggaaaggctccctgccagcaggttcttgcccacctggcccagctcaccatccccagcaacttcaccgcactctccttcttcatgggcttcatggactcccacagggatgccatcctgactatgaagccctagtgggccccctgcacagcctcctcaagcagaagcctgactggcagtgggaccaggagcatgaggaggccttcctggccctgaagcgagccctggtgtctgccctctgcctgatggcccccaactcccagctgcccttccgcctggaggtgaccgtgagccacgtggccctgacggccatcctccatcaggagcactcagggaggaagcaccccatagcctatacctcaaaacccctcctccctgatgaggagagccagggcccccagtcagggggtgacagcccctatgctgtggcctgggccctcaagcatttttcccgctgcattggagacaccccggtggtcctggacctttcctatgcctcccggaccactgcggaccctgaggtgcgggagggccgcagggtttccaaagcttggttgatccgatggtccctcttggttcaggacaaaggcaagagggccctggaattggccctcctccagggcctgctgggggagaaccgcctgctcacccccgcggcctccatgcctcgcttcttccaggttctgccgcctttctctgacctgtccacgttcgtctgcatccacatgtcgggctactgcttctaccgtgaggatgagtggtgtgctggctttggtctctatgttctatcgcccaccagcccccctgtctccctttccttctcctgctccccttacacgccaacctatgcccacctggcagccgtggcctgcggcctggagcgctttggccagtccccactcccagtggttttcctcactcactgcaactggatcttcagcctcctgtgggagctcctgcccctctggagggctcggggcttcctctcctctgatggggctccactccctcacccaagcctgctctcctacattatatccctcacctctggcctctcatcccttccgtttatctaccgaacctcctaccggggctctctgtttgctgtgacagtggacaccctggccaagcagggtgcccaggggggtgggcagtggtggagtttgccaaaggatgtgccagcccctacagtgagtccccatgccatgggcaaggggcccaatttgctggcattacagctgagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagtccccatggcccctcaggtcgaccgccccctggtcgaacctgcagatcgaggtggtgggcccggtcaccataagtgaggagggccataagcatgtacttattgtggctgacccaaacaccaggtgggtggaggcattccccctgaagccctacacacacacggctgtggcccaggtgctgcttcagcatgtgtttgcaaggtggggtgttcctgtgaggctggaggcagcccaggggccccagtttgcccggcacgtccttgtgagctgtgggctggccctgggagcccaggtggcctccctgagtcgggacctccagttcccctgcctgacgagctcaggggcctactgggaattcaagagggccctcaaggagttcatcttcctgcatgggaagaagtgggcggcctccctgcctttgctgcacctggccttcagggcctcctccactgatgccacaccgttcaaggtcctgaccgggggtgagtcaaggctcacggagcccctgtggtgggagatgagcagcgcaaacattgaagggctcaagatggacgtcttcctgctacagctggtgggggagctgctggagctccactggagggtggctgacaaggcgagtgaaaaggccgagaacaggcgtttcaagcgggagagccaggagaaggagtggaatgtgggtgaccaggtccttttgctgtccctccccaggaatggcagcagtgccaaatgggtgggtcccttctatatcggggaccggctgagcctgtcactctataggatatggggcttcccaaccccagagaagctggggtgcatctatcccagcagtctgatgaaggcctttgccaagagtggcaccccgctgtccttcaaggtcttggagcagtgagcgggagcagcgggggtgccccctgccccagggccgtgggtttctgctgctaggcctccccctgtcccagcagtgctctcagtccactgggggccctcagttgtgccttttgtagagaacttgcttcataaagctttgctgaattgccttgaactagggaccagcatccccatggaaacatccccagtttggggtacttggagaatttgccaaaggctgtcagatatgggtccctggcagttttacactgggaaatagagtgctcctctaggctataccaggctcagtgtcttctccccaagtatcctctttccccttcacatgtaggtgtgtggtggtgtgcacacacactcacgaaagaatctatcttggccatgaaactgtggctgttgaccttggaattggaaccacagtcctttcccatacagaaaccccaaatgtgggctcctccctccaacctgttcttttggggaccctttgcccttagagctgtcacagatgacataagcctgggcaggctgtggggaggccgctgcctcctagcctcacggtcagctttctcaagccaggtgtggcctgcacagctgtcagggcagggctggccatcctcccaggcctcaagggcagtgtcttggagtgggaggatggccagccacaagccaccagcttgtcagcatgggaagggcaagggggaaatgggttggcctacctcatttgactccagccaatggagacaattcctgacccctgctttgatggtgttgaccccacaggaatcaaggatcttgatgccaagtgtggcatctctacctgaagagctgcttctgttagacccaggggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaagtgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctatccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactgga

SEQ ID NO: 417304 - DNA, 429 bp, Homo sapiens
ccctccccagcagcagaaggaagccccagccatggtgtccgtgggagagagtcctggaccctttgtggacatggggaccctccagaacaggggcccagaaaattcaaagagattatctagcctgggagccactgggtccctgatcacagcccagagcacaccgcaggaggcagcaaaccagctggtacgggtcggttccaacaaccaagatggtatggacagtgctcaagaggaagggacagtgcaagccaccagcagccaggactccacgaaccacacacaagccttgttgaagcaaaggcaggtccagcctcactctccctccctggtgctgtatgcgttccccctgttagctacatttgtgatcacatacccttcttttaagtgaatttttttcatttgatttgtcaataaacgaatcaaactgga

SEQ ID NO: 417305 - DNA, 303 bp, Homo sapiens
cctgtccaaccggacgcattcacatgagtgctgaggtcatagcgttcgaatcgtgtgagtgagaacctctggtgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactgga

SEQ ID NO: 417306 - DNA, 1911 bp, Homo sapiens
tgctacaaccccgggcaggaagagctcgtcgcggtagcagcggtcgaaggggaccaagctccagagggcgggcgcccgagccgtgcggggagcgggcggggcagccatgctcctgtctgggggcgatccttctcctgctccccttacacgccaacctatgcccacctggcagccgtggcctgcggcctggagcgctttggccagtccccactcccagtggttttcctcactcactgcaactggatcttcagcctcctgtgggagctcctgcccctctggagggctcggggcttcctctcctctgatggggctccactccctcacccaagcctgctctcctacattatatccctcacctctggcctctcatcccttccgtttatctaccgaacctcctaccggggctctctgtttgctgtgacagtggacaccctggccaagcagggtgcccaggggggtgggcagtggtggagtttgccaaaggatgtgccagcccctacagtgagtccccatgccatgggcaaggggcccaatttgctggcattacagctgagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaagtgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctatccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactgga

SEQ ID NO: 417307 - DNA, 5546 bp, Homo sapiens
aaacatcacctgcaggtcccaaaacacccaaagctcaagccgggcctgcagctacagtttccaaagcacctgcagcttccaaagcacctgcagctcccaaagtacctgtgacccccagagtctccagagctcccaaaacacctgcagctcagaaggtgcccacggatgcagggccaaccttggatgtagccagacttctgagtgaggtccagcctacatcaagggctagtgtctccttactgaagggccaggggcaggctggaaggcagggtccccagtccagtggcaccttggccctcagcagtaagcaccagtttcagatggaggggctcctgggggcttgggagggggccccaaggcagccacctcgccacctgcaagcgaacagcacagtgaccagcttccagaggtaccacgaggccctgaatacacccttcgagctgaacctgtcaggggaacctggaaaccaggggttgcggcgagtggtcatcgatggcagcagtgtggccatggtgcatggcctgcagcacttcttctcctgccgaggaattgccatggcagtgcagtttttctggaaccggggacaccgagaggtcactgtgtttgtacccacctggcagctgaagaagaaccggagggtgagagagagccactttctgacgaagctacactcgctcaagatgctttcaatcacaccctcccagcttgagaatggcaagaagatcaccacctacgattataggttcatggtaaagctggcagaggagacagatggcatcattgtcaccaatgagcagattcacatcctgatgaatagttccaagaaactgatggtcaaagatcgcttgctgcctttcacctttgcggggaatctcttcatggtgcctgatgaccccctgggccgtgatggccccaccttggatgagtttctgaagaagccaaacaggttggacactgacattggcaacttcctgaaggtgtggaagacccttcctcccagctcagccagtgtcactgagctgagtgatgacgctgactctgggcccctggagagtctgccgaatatggaagaagtcagggaagagaaggaggagaggcaggatgaggagcagagacaggggcagggcacacagaaggcggctgaggaggacgaccttgactcttcgctggccatcgacctcctgccaggggcagcttctccctacctgggcatcccctgggatggaaaggctccctgccagcaggttcttgcccacctggcccagctcaccatccccagcaacttcaccgcactctccttcttcatgggcttcatggactcccacagggatgccatcctgactatgaagccctagtgggccccctgcacagcctcctcaagcagaagcctgactggcagtgggaccaggagcatgaggaggccttcctggccctgaagcgagccctggtgtctgccctctgcctgatggcccccaactcccagctgcccttccgcctggaggtgaccgtgagccacgtggccctgacggccatcctccatcaggagcactcagggaggaagcaccccatagcctatacctcaaaacccctcctccctgatgaggagagccagggcccccagtcagggggtgacagcccctatgctgtggcctgggccctcaagcatttttcccgctgcattggagacaccccggtggtcctggacctttcctatgcctcccggaccactgcggaccctgaggtgcgggagggccgcagggtttccaaagcttggttgatccgatggtccctcttggttcaggacaaaggcaagagggccctggaattggccctcctccagggcctgctgggggagaaccgcctgctcacccccgcggcctccatgcctcgcttcttccaggttctgccgcctttctctgacctgtccacgttcgtctgcatccacatgtcgggctactgcttctaccgtgaggatgagtggtgtgctggctttggtctctatgttctatcgcccaccagcccccctgtctccctttccttctcctgctccccttacacgccaacctatgcccacctggcagccgtggcctgcggcctggagcgctttggccagtccccactcccagtggttttcctcactcactgcaactggatcttcagcctcctgtgggagctcctgcccctctggagggctcggggcttcctctcctctgatggggctccactccctcacccaagcctgctctcctacattatatccctcacctctggcctctcatcccttccgtttatctaccgaacctcctaccggggctctctgtttgctgtgacagtggacaccctggccaagcagggtgcccaggggggtgggcagtggtggagtttgccaaaggatgtgccagcccctacagtgagtccccatgccatgggcaaggggcccaatttgctggcattacagctgagtgacagcaccctggccgacatcattgccaggctgcaggctgggcagaaactgtctggctcctcaccgtttagttctgcctttaactcactcagcctcgacaaggagagtggcctgcttatgttcaagggagataagaagcccagggtctgggtagtcccgacgcaactccggagggatctgattttctctgtgcatgacattcccttgggggcccaccagaggcccgaagagacctacaagaagttgcgtttgctggggtggtggcctgggatgcaggagcatgtgaaagattactgcaggagctgcttgttctgcatcccccgaaatctcataggcagcgagttgaaggttattgagtccccatggcccctcaggtcgaccgccccctggtcgaacctgcagatcgaggtggtgggcccggtcaccataagtgaggagggccataagcatgtacttattgtggctgacccaaacaccaggtgggtggaggcattccccctgaagccctacacacacacggctgtggcccaggtgctgcttcagcatgtgtttgcaaggtggggtgttcctgtgaggctggaggcagcccaggggccccagtttgcccggcacgtccttgtgagctgtgggctggccctgggagcccaggtggcctccctgagtcgggacctccagttcccctgcctgacgagctcaggggcctactgggaattcaagagggccctcaaggagttcatcttcctgcatgggaagaagtgggcggcctccctgcctttgctgcacctggccttcagggcctcctccactgatgccacaccgttcaaggtcctgaccgggggtgagtcaaggctcacggagcccctgtggtgggagatgagcagcgcaaacattgaagggctcaagatggacgtcttcctgctacagctggtgggggagctgctggagctccactggagggtggctgacaaggcgagtgaaaaggccgagaacaggcgtttcaagcgggagagccaggagaaggagtggaatgtgggtgaccaggtccttttgctgtccctccccaggaatggcagcagtgccaaatgggtgggtcccttctatatcggggaccggctgagcctgtcactctataggatatggggcttcccaaccccagagaagctggggtgcatctatcccagcagtctgatgaaggcctttgccaagagtggcaccccgctgtccttcaaggtcttggagcagtgagcgggagcagcgggggtgccccctgccccagggccgtgggtttctgctgctaggcctccccctgtcccagcagtgctctcagtccactgggggccctcagttgtgccttttgtagagaacttgcttcataaagctttgctgaattgccttgaactagggaccagcatccccatggaaacatccccagtttggggtacttggagaatttgccaaaggctgtcagatatgggtccctggcagttttacactgggaaatagagtgctcctctaggctataccaggctcagtgtcttctccccaagtatcctctttccccttcacatgtaggtgtgtggtggtgtgcacacacactcacgaaagaatctatcttggccatgaaactgtggctgttgaccttggaattggaaccacagtcctttcccatacagaaaccccaaatgtgggctcctccctccaacctgttcttttggggaccctttgcccttagagctgtcacagatgacataagcctgggcaggctgtggggaggccgctgcctcctagcctcacggtcagctttctcaagccaggtgtggcctgcacagctgtcagggcagggctggccatcctcccaggcctcaagggcagtgtcttggagtgggaggatggccagccacaagccaccagcttgtcagcatgggaagggcaagggggaaatgggttggcctacctcatttgactccagccaatggagacaattcctgacccctgctttgatggtgttgaccccacaggaatcaaggatcttgatgccaagtgtggcatctctacctgaagagctgcttctgttagacccaggggccccggcctctgttttaagggggcagggcgtctgcaacaggagtggcacacggtgaagtgctggcatggctctacctcccaacccctcccaaccccatcccaaagcctacagtcctctgctccttctacctccactgtatcctgcatcccagaccctacagattgtgtgattgcttcatctgtatcaccccccgagtcctgtggacctgccttctgtgtagagcaaaacccaggctccctcacagccattctttgcagagatcacccttgcagtgagtgtgagttccttccaggtgtgtgcgcgtacactcaccctctgaattgctgccgctgccaaggaagtgggctccaggtgaaggccagtgccacgtcactctggctggccttcttagtagtttcatttctccggaagctgagccagtctcctggtctagcccaggttgccagaacgcttggcattgcagagtgctagagccagtggagaacttgccaacttgattgttttacagcagaggaaagaggatcacagagggaaagtgattcacccaaagtcacacagcaagttcatggctgagctgagaccaggattaagcttcctgactcccagttcaccatgaaaagggttctggcaacaggttcaagctggagaatccttcaaaatgctacacccacattctctccaactcttcatctccctgatcttccagacaaactacctggatgttgcccttaaaccatttctagctgttaaccctatccagaaaaatgattgagtgatagctgagaagtggaaagtgtgggatttttggcaggtgctctctttcctccgccccccgcgccattctttctcttcctcctctctgtaatggtatgtccagcctcactctccctccctggtgctgtatgcgttccccctgttagctacatttgtgatcacatacccttcttttaagtgaatttttttcatttgatttgtcaataaacgaatcaaactgga

SEQ ID NO: 417308 - DNA, 189 bp, Homo sapiens
  misc_feature (25)..(25): n is a, c, g, or t
  misc_feature (61)..(61): n is a, c, g, or t
gagcggaaggcgcaggccacagggngcagagcgcaaggccatggcgaggacgcggccccgncgggcgttccagagccggccggaccgaccctgcgggagcggcctccccggaccgtgggggtcctggcgggcgcgggggacacgaggggcgccggcaaagcagggggtcacccgggccccgcaccccct

SEQ ID NO: 417309 - DNA, 646 bp, Homo sapiens
gaatgcagcttcacctttccacatcactccagactagatgcgtaatcagtccctctgacactgctgctggaatagtaatctgacacctgccgtcagctgagggtccttggctattgactgtgcagagctgtgggagagtggacagcccagagacaaccggagaagcagatcttattactggaataattgcacctttgtgttccaacactgcacagtatttttctcaggagccaaaactggcttctaagattcttggattccaggctcaccattccaggcaaggtgatagggaattgtaataacttcaccttattcccggtatcagattaacatgcatgttggctttgaaagatgtggcatttccatccttagagtctatgaacatgtacggattatttatgggtgtagaggatgccccccaaagtaaagcagttctctcctttattcatcattcctcccacagcactgccaggctttgtcttctttgtctctaattgcagtgctaaagggaaatgtccccaggccagagcaaagaacctttaccttcaaatataccttggatcaaagagagaaagcccctgcatccctccatcagattgatagtgtgagacactttttctcttgattatgggtaccgtggacttga

SEQ ID NO: 417310 - DNA, 402 bp, Homo sapiens
tcaggcaatgctgagatcatgggctttgtcagggcttgcagatgtgctgcctatgacttcgttaacataattgattaggagctaggacatatttagtattaatcaggctgtttttagtgaggctgattatgccagtcctcttgatgcactattttagtctggaacttccttagaaccaagctgcaaaaagaaaaaaaaaataaaggctttatgtaaaaaggaggaactttcatgtggcactaaagtatgctgttatatttgaggaatacaattatatcaggtcaaaatgtaggagaatgtacatatttcaattttaatgttttttaaaagtagagctcatatagagactagattattaaatttgttcacaggagactagaaacaaataaaacttcattagta

SEQ ID NO: 417311 - DNA, 754 bp, Homo sapiens
cagcggggcacgtgagcgatggagaccatctggatctaccagttccgcctcatcgtgatcggggactccaccgtgggcaagtcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcagatcaataacccgatcttattaccgcaactcagttggtggatttttagtatttgacattactaaccgacgatcttttgaacatgtgaaagattggctagaagaagcaaaaatgtatgtacagccatttcggattgtatttctgctagtgggacataaatgtgatttagcttcacaacgtcaagttacaagggaagaagctgaaaaactgtcagcagactgtggaatgaagtatatagaaacctcagcaaaggatgctacaaatgttgaagaatccttcacaatcttgacgagagacatatatgaacttattaaaaagggagaaatttgtattcaggatggctgggaaggggttaaaagtggttttgttccaaatactgtgcattcttctgaggaagcagtaaagcccaggaaagaatgcttctgctgacttcaaacatgctgaagaactaacaggaacagattgggtgtcagttcaggataaataccaacattaacagcagaatgatgca

SEQ ID NO: 417312 - DNA, 573 bp, Homo sapiens
gaaaggaactctaggtctggttgccagattcagcaaatgaaaatacaggatgcccagttacatcaaatttcaataaacaatgaatcattctttcatctaagcatgttccatggagtttgtctgaaattcaaatgtaactgggtgtcctgtattttatctggcaactcttaactatagggccactcccatctctctgccctctgtcttgtcttcctctcatcatcaataggctgtctccctgcttccatttcccctctgatgcccatctctggaacaactgagctgtacctgtccatgtattcttatttaaaatcaattattggctgggcgcgttggctcacgcctctaatcccagcactttgggaggccaaggtgggtggatcacgaggtcaagagattgagatcttcttggccaacatggtgaaaccccatctctactaaaaatacaaaaattagttgggcgtggtgggaggctgagtcaggagaatcgcttgaacccgggaggcggaagttgcagtgagccaagatggcgccactacactccagcctggcgacagagcgaggcgccgtctc

SEQ ID NO: 417313 - DNA, 140 bp, Homo sapiens
gacggacgccttagcactcccctctcacgcctctgccttcggcctcagtgattggcgtctcctcaaggagccatgatttctttgtccattttttaaatgtgctgaggccctttaggagaaaaaccacgcagccaaatgag

SEQ ID NO: 417314 - DNA, 335 bp, Homo sapiens
  misc_feature (26)..(27): n is a, c, g, or t
gggttttaaagtttggggttttaaanncccttgggggaaagcccaaatttaaacaccccccttattattaaatttacctaaaatgggaaggggcttttagtcactgaaatatgcatcgtgtaacaaagatgaagaaaatacatggcttgtgcccatcataaaaaaagattcagactgaaggcttagctttggttttttcaattaagattgttctcctgtgcacagtgtcattgtttattagaacttcagactttcggtggggcgggcgtttatatttatttatgtgaaagtcaaattcatgtacagtaaatttgttataagaatattaaaaaaaa

SEQ ID NO: 417315 - DNA, 2239 bp, Homo sapiens
aaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaagattgttctcctgtgcacagtgtcattgtttattagaacttcagactttcggtggggcgggcgtttatatttatttatgtgaaagtcaaattcatgtacagtaaatttgttataagaatattaaaaaaaa

SEQ ID NO: 417316 - DNA, 1597 bp, Homo sapiens
aaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattccccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaagattgttctcctgtgcacagtgtcattgtttattagaacttcagactttcggtggggcgggcgtttatatttatttatgtgaaagtcaaattcatgtacagtaaatttgttataagaatattaaaaaaaa

SEQ ID NO: 417317 - DNA, 356 bp, Homo sapiens
atttaaattttcatttatttttatcaagatagggtctcactatgttgcccaggttggtctcaaacttttggcctaaagcaatcctcccaccttggcctcccaatgtgctgggattacaatgtgagccaccacgtccagcctcctgggatatttctcaatgaaacattggatgccaagattggttttgtgccacatgccaatttcacagaagccagtctatgagccaccagctctactcagcaattacagtttctggaactttggctaaattcctgtagatgcaccactgcttgtggcctgactctttgccacccaagtgcgctcagcctcccctggggagtctgccaggcttgcat

SEQ ID NO: 417318 - DNA, 1197 bp, Homo sapiens
atctgagatgaggggctcccagaggcttgggcaagtccagcggggggcatcgggaagaccctctctggtgctggtgttctgggacatgacactgactgtcccttatttgttaaaatttgcaatatctctcaagtaaataatagccaacatttgttgaatgctttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacactgtgctgggaattgctcatgggttgtcctgtttcatcttctccgtagccctgtgagatcggcaatattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaag

SEQ ID NO: 417319 - DNA, 5120 bp, Homo sapiens
ttttcttttttaaaataaaaaccatagatttcccaccctctttaatcccttctttttaaaaatgttctcttctctgctctacgtcctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggctgctcaggcatcacaggctgcaccccctctgaaagcatccccactgggctccggccacatcttcagtgcactgtgctgtgtgcgctgggtgctcacacgctgtccccagacccacaaagtgctaggccccagttgaagaaaggggtgaaatagccagcttcaccgaagggaagggaagggaagtattgggcgatgccagccccacagacgctcagcaaacattagtgcacattctcctagtcctcacccaatggcctcctctacccccatgcatggagctgccacatcagaagccccaagagaagctccctgcaggagaggccagctccctggatgcccaattgcatacctggccgaatctgccattgagtcaccttagcaaataggctgctgtcactaggaccaagctctcaagcagagggatgccaacctagtccttacttagcccacgaatcatctagagcatcctctagtcttttgtgggctccctccttcccatttgaagagacattgttcagaggaagaggggaagatttgaaatgtcaggtcacggaggagtgtttaactggagcctggtgaaccgcagggcaatttgcttctgctcactgggttctgactggcccgtctggacgtgggcccccatgtctctgtgcttagggcctcttcatgatgttttggatgtttccaagggaagtgggtgagcagatcaaggggtgggagagtcgaggcttgatgccagttaatactgtgaagtggagcgtgcggtcagtggaattcagaggaaaaagaagggttggagcaaagcggcattcatctcctggactgttagcctttctagtcttcctggtggctgaggtgttcacgggctgggggagccagctgacctttgtcctcttcaacctagaagactcagcccgcccagacaccaacgtgtgagacggatggacatcaggaagggaaggggagattagcccaactgctgacagaacgatttcccttggttggaccttgggaatggcaaacactcatattggaacaagcttggggtggaagatttaggccgtgtgagcgtgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtccttttttttaaaaaaaaaaaatgcatttatttcaaaactgtgctattcttttaagaggagtggaggtgaccccttcgatgctgctgctatcgggagacaaggtgccataccaatacgtgggcttgactaatcccaggccaccatgggagagagcaaagcagggctgccaggagttcagttgcatcaagggcgtagagcacgcgggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttatttgttaaaatttgcaatatctctcaagtaaataatagccaacatttgttgaatgctttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacactgtgctgggaattgctcatgggttgtcctgtttcatcttctccgtagccctgtgagatcggcaatattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaag

SEQ ID NO: 417320 - DNA, 5067 bp, Homo sapiens
ttttcttttttaaaataaaaaccatagatttcccaccctctttaatcccttctttttaaaaatgttctcttctctgctctacgtcctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggctgctcaggcatcacaggctgcaccccctctgaaagcatccccactgggctccggccacatcttcagtgcactgtgctgtgtgcgctgggtgctcacacgctgtccccagacccacaaagtgctaggccccagttgaagaaaggggtgaaatagccagcttcaccgaagggaagggaagggaagtattgggcgatgccagccccacagacgctcagcaaacattagtgcacattctcctagtcctcacccaatggcctcctctacccccatgcatggagctgccacatcagaagccccaagagaagctccctgcaggagaggccagctccctggatgcccaattgcatacctggccgaatctgccattgagtcaccttagcaaataggctgctgtcactaggaccaagctctcaagcagagggatgccaacctagtccttacttagcccacgaatcatctagagcatcctctagtcttttgtgggctccctccttcccatttgaagagacattgttcagaggaagaggggaagatttgaaatgtcaggtcacggaggagtgtttaactggagcctggtgaaccgcagggcaatttgcttctgctcactgggttctgactggcccgtctggacgtgggcccccatgtctctgtgcttagggcctcttcatgatgttttggatgtttccaagggaagtgggtgagcagatcaaggggtgggagagtcgaggcttgatgccagttaatactgtgaagtggagcgtgcggtcagtggaattcagaggaaaaagaagggttggagcaaagcggcattcatctcctggactgttagcctttctagtcttcctggtggctgaggtgttcacgggctgggggagccagctgacctttgtcctcttcaacctagaagactcagcccgcccagacaccaacgtgtgagacggatggacatcaggaagggaaggggagattagcccaactgctgacagaacgatttcccttggttggaccttgggaatggcaaacactcatattggaacaagcttggggtggaagatttaggccgtgtgagcgtgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtccttttttttaaaaaaaaaaaatgcatttatttcaaaactgtgctattcttttaagaggagtggaggtgaccccttcgatgctgctgctatcgggagacaaggtgccataccaatacgtgggcttgactaatcccaggccaccatgggagagagcaaagcagggctgccaggagttcagttgcatcaagggcgtagagcacgcgggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttattttttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacactgtgctgggaattgctcatgggttgtcctgtttcatcttctccgtagccctgtgagatcggcaatattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaag

SEQ ID NO: 417321 - DNA, 2118 bp, Homo sapiens
ttttcttttttaaaataaaaaccatagatttcccaccctctttaatcccttctttttaaaaatgttctcttctctgctctacgtcctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggctgctcaggcatcacaggctgcaccccctctgaaagcatccccactgggctccggccacatcttcagtgcactgtgctgtgtgcgctgggtgctcacacgctgtccccagacccacaaagtgctaggccccagttgaagaaaggggtgaaatagccagcttcaccgaagggaagggaagggaagtattgggcgatgccagccccacagacgctcagcaaacattagtgcacattctcctagtcctcacccaatggcctcctctacccccatgcatggagctgccacatcagaagccccaagagaagctccctgcaggagaggccagctccctggatgcccaattgcatacctggccgaatctgccattgagtctgtattaactgcttgggatcctctaga

SEQ ID NO: 417322 - DNA, 1207 bp, Homo sapiens
ttttcttttttaaaataaaaaccatagatttcccaccctctttaatcccttctttttaaaaatgttctcttctctgctctacgtcctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaaaaaaactcaaggggggcccgtacccaattcgccctatgggagtcggatacaataactggccgcggtttacacgccgggatgggaaaacccggcgttcccacttaatgcctggagacaaccctt

SEQ ID NO: 417323 - DNA, 5066 bp, Homo sapiens
ttttcttttttaaaataaaaaccatagatttcccaccctctttaatcccttctttttaaaaatgttctcttctctgctctacgtcctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggctgctcaggcatcacaggctgcaccccctctgaaagcatccccactgggctccggccacatcttcagtgcactgtgctgtgtgcgctgggtgctcacacgctgtccccagacccacaaagtgctaggccccagttgaagaaaggggtgaaatagccagcttcaccgaagggaagggaagggaagtattgggcgatgccagccccacagacgctcagcaaacattagtgcacattctcctagtcctcacccaatggcctcctctacccccatgcatggagctgccacatcagaagccccaagagaagctccctgcaggagaggccagctccctggatgcccaattgcatacctggccgaatctgccattgagtcaccttagcaaataggctgctgtcactaggaccaagctctcaagcagagggatgccaacctagtccttacttagcccacgaatcatctagagcatcctctagtcttttgtgggctccctccttcccatttgaagagacattgttcagaggaagaggggaagatttgaaatgtcaggtcacggaggagtgtttaactggagcctggtgaaccgcagggcaatttgcttctgctcactgggttctgactggcccgtctggacgtgggcccccatgtctctgtgcttagggcctcttcatgatgttttggatgtttccaagggaagtgggtgagcagatcaaggggtgggagagtcgaggcttgatgccagttaatactgtgaagtggagcgtgcggtcagtggaattcagaggaatcttcctggtggctgaggtgttcacgggctgggggagccagctgacctttgtcctcttcaacctagaagactcagcccgcccagacaccaacgtgtgagacggatggacatcaggaagggaaggggagattagcccaactgctgacagaacgatttcccttggttggaccttgggaatggcaaacactcatattggaacaagcttggggtggaagatttaggccgtgtgagcgtgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtccttttttttaaaaaaaaaaaatgcatttatttcaaaactgtgctattcttttaagaggagtggaggtgaccccttcgatgctgctgctatcgggagacaaggtgccataccaatacgtgggcttgactaatcccaggccaccatgggagagagcaaagcagggctgccaggagttcagttgcatcaagggcgtagagcacgcgggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttatttgttaaaatttgcaatatctctcaagtaaataatagccaacatttgttgaatgctttcatgactcccgggctaaggcctttatgagcgttgtctcaaggggccccaacagccatcccacagggagggggataacagcccccatttatagataagggagctgaccggatgctctgagaagtggcaggtgttgaaggaaggataaagcagtgatgggccagaatccccaaggttcccttttttgttcatcaggcccttcctgagatgtgatttttaatcttttaactttttttaattaatagcaatgcgtggcctcatatttctatgaaccatttagtgatactcccgcttcctgcatgccacacactgtgctgggaattgctcatgggttgtcctgtttcatcttctccgtagccctgtgagatcggcaatattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaag

SEQ ID NO: 417324 - DNA, 1889 bp, Homo sapiens
ttttcttttttaaaataaaaaccatagatttcccaccctctttaatcccttctttttaaaaatgttctcttctctgctctacgtcctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcagccagatggcagcaatagcccattaggtctcatcccgagttccaagtcttggctgcaaatgagcctcagttcgccttactggagagcacccccagattcctgggcacagttcatttccagccctttctagatctgatcttttagggggaaagacagcttaaaatgttcttttcattttaaagaaaattattctgtctgcttaagttggaggctacttactctttcacctgacattttctttccttttattcttccagatcaggaatgaaatttccatgctgctcataaagataatattattgtactaattatttttattaccattgtaattatgatcattatgttgatattttagtcagggttttaaatgcacatttattccaagtatctttgtgttttctctttaatatttaaacttattctctctgtgagtatataagtagactggagggacatccagatgtccagttttgtcaggcaaaaaaaaaaaggaaagacttaggaagtaggaaaattgtttctgtcatctctatcccaacaagagacgtcaagaaagatccaccacagaacaaaagtttaaagaagaatcaaagccttgattgggcttctgacaacatggtcaccatcaaggttgtcattttctagatcccagaggcctgggatgcgacgtcaggtggcatctcatgggctcggggaatgtcgagtcactgactgtccagcccttagccagcttctctcccacatcctcagagctctcctgtgcttctgaaatctgttaactaaatctttggcttgcctctggtatttaagcaagaaaattccctcccagaggtgaccccatccgcttccccacaatccatccttttgccatcggcgcacctggggcgtggcttaggttcttcaatgcagggacatttgccccctcccagaagctgctgggcacagtgaggtggcgtaagagtgactggcaggtggtaccttccccaggaaatttcaccacaccacccagttcctcagcctgccccctccccctgtgatgcatgcccccagcacccaattctagccagctggaagtgggtggagggacagcaggaggccagagaaaccctgaacaaagctgggcggggtcagcatcagggggaccccttaaaaatcccagggcccgccatctcggacgggctgctcgggggccaagggcccaaacaagggtgcccgaggggcacccacggggaggacctcgtgcccccagaccaacacggaactaccagagccaccgaggcgaccaaccgagccatg

SEQ ID NO: 417325 - DNA, 530 bp, Homo sapiens
gcggccccatcctcatcctccctccctttacttcctcactgtgcagtctccctcaaggatctactgtgaaaggtgtgtttgtagtgatatccaacctaactcagtaacgaagtcgttacttagctcttagctgtgaaataactctggaaacttccccaccccaaccataaattcttacttataaagaaacaggtccccaaactggaaacagcttagtccaggcctcagcgagaaggaaggacaccatgactgctccatgctgggcacagccgggcagtcttgccaagtgcctgctggaggctgtgccggcaagaggcctgcagcaaggagattcccttccctcgggccattatcaatactgtctttatctggaggtggggaagcgcagccctctgagacagcaggacaatggtcagttcagagagggtgagggcagcaaacgcttcagaggacacagaagccagaggacccccccccgccccacagctgggtcagcctggaaaatccatctattagggactttttggcag

SEQ ID NO: 417326 - DNA, 807 bp, Homo sapiens
attgaaatggaaatgaaaacagccagtaacttatgtttcagaatgtttgtaacacacttcatggtgttcccataggcttgtgtttgtattatctgtgcattaatggtcctcatctgactcctgcattgtgtcttatttttctgcatggattggcataagaccattactaaaatttggcacctgtgagatgtttgatattatgaacaggaaacataatttaatgtatgaatagatgtgaatttgggatttcaaaatagatgaataacaactattttatagtaaagttattgaaatggaaatgaaaacagccagtaacttatgtttcagaatgtttgtaacacacttcatggtgttcccataggctttgctgtctagtcttatagtttgaggtttttttggtctgcatttttctttttgattacaaaatttataatttaataaatactagagtttatcaaaaaaaaaaaaaaaaagaaaaaaaaaaaaaaaaaaaaaaaaaaaaaaaaaaaaaaaagaaaaaaaaaaaaaaaaaaaaaaggaggggggggggccccgatgaaaaactccccagggggagaccagtatgaacaccaccaccatctgccaggaaacgggcggcccaacaagcggccgtatataaccgagagacggggggccgccataaacacagtgggggagcagcaactctccggtgcaatcttgggagacacacccggcggggggaactaggcgcacaccccgcagaataccgcgaggaacaaaacacggcgtatgcagacccgcgtgtcgccaacagccagcttctga
